(12) United States Patent
Liras et al.

(10) Patent No.: US 9,340,553 B2
(45) Date of Patent: May 17, 2016

(54) SUBSTITUTED-6,8-DIOXABICYCLO[3.2.1] OCTANE-2,3-DIOL COMPOUNDS AS TARGETING AGENTS OF ASGPR

(71) Applicant: Pfizer Inc., New York, NY (US)

(72) Inventors: Spiros Liras, Brookline, MA (US);
Vincent Mascitti, Groton, CT (US);
Benjamin Thuma, Old Lyme, CT (US)

(73) Assignee: Pfizer Inc., New York, NY (US)

( * ) Notice: Subject to any disclaimer, the term of this patent is extended or adjusted under 35 U.S.C. 154(b) by 0 days.

(21) Appl. No.: 14/714,484

(22) Filed: May 18, 2015

(65) Prior Publication Data
US 2015/0329555 A1   Nov. 19, 2015

Related U.S. Application Data

(60) Provisional application No. 62/000,211, filed on May 19, 2014, provisional application No. 62/001,540, filed on May 21, 2014, provisional application No. 62/139,254, filed on Mar. 27, 2015.

(51) Int. Cl.
| | | |
|---|---|---|
| C07D 405/14 | (2006.01) | |
| C07D 493/08 | (2006.01) | |
| C07D 309/14 | (2006.01) | |
| C07H 13/04 | (2006.01) | |
| C07H 15/26 | (2006.01) | |

(52) U.S. Cl.
CPC ............ *C07D 493/08* (2013.01); *C07D 309/14* (2013.01); *C07H 13/04* (2013.01); *C07H 15/26* (2013.01)

(58) Field of Classification Search
USPC .......................... 546/268.4; 548/256; 549/397
See application file for complete search history.

(56) References Cited

U.S. PATENT DOCUMENTS

2014/0099333 A1   4/2014   Schwink et al.

FOREIGN PATENT DOCUMENTS

| | | |
|---|---|---|
| CN | 103570657 | 2/2014 |
| CN | 103772449 | 5/2014 |
| CN | 103864737 | 6/2014 |
| CN | 104017031 | 9/2014 |
| CN | 104031098 | 9/2014 |
| EP | 0341062 | 11/1989 |
| EP | 0341063 | 11/1989 |
| WO | 91/09537 | 7/1991 |
| WO | 93/07167 | 4/1993 |
| WO | 95/15979 | 6/1995 |
| WO | 20101023594 | 3/2010 |
| WO | 20111051864 | 5/2011 |
| WO | 20121019496 | 2/2012 |
| WO | 20121041898 | 4/2012 |
| WO | 20121172566 | 12/2012 |
| WO | 20131038429 | 3/2013 |
| WO | 2014/018671 | 1/2014 |
| WO | 2014/094544 | 6/2014 |
| WO | 2014/159151 | 10/2014 |
| WO | 2014/161836 | 10/2014 |

OTHER PUBLICATIONS

Plet, J.R.H. et al. : Approaches to tagetitoxin and its decarboxy analogue from D-glucose. Synlett, vol. 20, pp. 3258-3262, 2009.*
Darbon et al., "Azido-2 Desoxy-2B-D-Galactopyrannoside Methylique, C7 H13N3O5, et Azido-2 Desoxy-2B-D-Galactopyrannoside Ethylique, C8H15N3O5", Acta Cryst. vol. C41, pp. 1100-1104 (1985).
Yan et al., "SHR3824, a novel selective inhibitor of renal sodium glucose cotransporter 2, exhibits antidiabetic efficacy in rodent models", Acta Pharmacologica Sinica, vol. 35, pp. 613-624 (2014).
Park et al., "Exploration of SAR regarding glucose moiety in novel C-aryl glucoside inhibitors of SGLT2", Bioorganic & Medicinal Chemistry Letters, vol. 21, pp. 742-746 (2011).
Witczak et al., "A potential CARB-pharmacophore for antineoplasic activity: Part 1", Bioorganic & Medicinal Chemistry Letters, vol. 24, pp. 1752-1757 (2014).
Martin et al., "α-and β-Homogalactonojirimycins (α- and β-Homogalactostatins): Synthesis and Further Biological Evaluation", Bioorganic & Medicinal Chemistry, vol. 9, pp. 1269-1278 (2001).
Cudic et al., "Synthesis, Conformation and T-Helper Cell Stimulation of an O-Linked Glycopeptide Epitope Containing Extended carbohydrate Side-Chains", Bioorganic & Medicinal Chemistry, vol. 10, pp. 3859-3870 (2002).
Khorev et al., "Trivalent, Gal/GalNAc-containing ligands designed for the asialoglycoprotein receptor", Bioorganic & Medicinal Chemistry, vol. 16, pp. 5216-5231 (2008).
Stokmaier et al., Design, synthesis and evaluation of monovalent ligands for the asialoglycoprotein receptor (Asgp-R), Bioorganic & Medicinal Chemistry, vol. 17, pp. 7254-7264 (2009).
Zhang et al., Synthesis of disaccharide congeners of the Trichinella spiralis glycan and binding site mapping of two monoclonal antibodies, Canadian Journal of Chemistry, vol. 80, pp. 1141-1161 (2002).
Paulsen et al., "Lewissaure-Katalysierte Synthesen Von Di- Und Tri-Saccharid-sequenzen Der O-Und N-glycoproteine. Anwendun von Trimethylsilyltriflouromethanesulfonat", Carbohydrate Research, vol. 135, pp. 53-69 (1984).

(Continued)

*Primary Examiner* — Charanjit Aulakh
(74) *Attorney, Agent, or Firm* — Lisa A. Samuels

(57) ABSTRACT

Compounds of Formula (A) are described herein and the uses thereof for the treatment of diseases, conditions and/or disorders mediated by pharmaceutical compositions and the uses thereof as asialoglycoprotein receptor (ASGPR) targeting agents.

(A)

15 Claims, 1 Drawing Sheet

(56) References Cited

OTHER PUBLICATIONS

Jacquinet et al., "Synthesis of Dermatan Sulfate Fragments: A Chemical Synthesis of Methyl 2-Acetamido-2Deoxy-3-O(a-L-Idopyranosyluronic Acid)4-O,sulfo-B-D-Galactopyranoside Disodium Salt and its Non-Sulfated Analogue", Carbohydrate Research, vol. 159, pp. 229-253 (1987).
Marra et al., "Synthesis of Disaccharide Fragments of Dermatan Sulfate", Carbohydrate Research, vol. 195, pp. 39-50 (1989).
Jacquinet, "Syntheses of the methyl glycosides of the repeating units of chondroitin 4- and 6-sulfate", Carbohydrate Research, vol. 199, pp. 153-181 (1990).
Paulsen et al., "Synthesis of the glycosyl amino acids Nα-Fmoc-ser[Ac4-β-D-Gal p(1→3)-Ac2-α-D-Ga1N3 p]OPfp and Nα-Fmoc-Thr[Ac4-β-D-Galp-(1→3)-Ac2-α-D-Ga1N3 p]OPfp and the application in the solid-phase peptide synthesis of multiply glycosylated mucin peptides with Tn and T antigenic structures", Carbohydrate Research, vol. 268, pp. 17-34 (1995).
Kajihara et al., "Novel features of acceptor recognition by β-(1→4)-galactosyltransferase", Carbohydrate Research, vol. 306, pp. 361-378 (1998).
Kalgutkar et al., "Prelinical Species and Human Disposition of PF-04971729, a Selective Inhibitor of the Sodium-Dependent Glucose Cotransporter 2 and Clinical Candidate for the Treatment of Type 2 Diabetes Mellitus", Drug Metabolism and Disposition, vol. 39(9), pp. 1609-1619 (2011).
Miao et al., "Pharmcokinetics, Metabolism, and Excretion of the Antidiabetic Agent Ertugliflozin (PF-04971729) in Healthy Male Subjects", Drug Metabolism and Disposition, vol. 41, pp. 445-456 (2013).
Bukowski et al., Synthesis and Conformational Analysis of the T-Antigen Disaccharide (β-D-Gal-1→3)-α-D-GalNac-Ome), European Journal of Organic Chemistry, vol. 14, pp. 2697-2705 (2001).
Kinzy et al., "Synthesis of methyl a- and B-N-dansyl-D-galactosaminides, probes for the combining sites of N-acetyl-D-galactosamine-specific lectins", Glycoconjugate Journal, vol. 9, pp. 225-227 (1992).
Mazur et al., "Digestibility of Selected Carbohydrates by Anaerobic Bacteria", Journal of Agricultural Food Chemistry, vol. 41, pp. 1925-1930 (1993).
Mamidyala et al., "Glycomimetic Ligands for the Human Asialoglycoprotein Receptor", Journal of the American Chemical Society, vol. 134, pp. 1978-1981 (2012).
Guru Raja et al., "Crystallographic studies of some cyclic benzylidene acetals: Key synthons for o-glycoamino acid building blocks and solid-phase oligosaccharide synthesis", Journal of Chemical Crystallography, vol. 28(10), pp. 747-759 (1998).
Procopiou et al., "The squalestatins: cleavage of the bicyclic core via the novel 6,8-dioxabicyclo [3.2.1] octane ring system", Journal of the Chemical Society, Perkin Transactions 1: Organic and Bioorganic Chemistry, vol. 11, pp. 1341-1347 (1995).
Mascitti et al., "Discovery of a Clinical Candidate from the Structurally Unique Dioxa-bicyclo[3.2.1]octane Class of Sodium-Dependent Glucose Cotransporter 2 Inhibitors", Journal of Medicinal Chemistry, vol. 54, pp. 2952-2960 (2011).
Tang et al., "A specific pharmacophore model of sodium-dependent glucose co-transporter 2 (SGLT2) inhibitors", Journal of Molecular Modeling, vol. 18, pp. 2795-2804 (2012).

Armstrong et al., "Total Synthesis of (+)-Zaragozic Acid C", Journal of Organic Chemistry, vol. 65, pp. 7020-7032 (2000).
Suzuki et al., "Tofogliflozin, a Potent and Highly Specific Sodium/Glucose Cotransporter 2 Inhibitor, Improves Glyemic Control in Diabetic Rats and Mice", The Journal of Pharmacology and Experimental Therapeutics, vol. 341(3), pp. 692-701 (2012).
Mascitti et al., "On the importance of synthetic organic chemistry in drug discovery: reflections on the discovery of antidiabetic agent ertugliflozin", Med. Chem. Commun., vol. 4, pp. 101-111 (2013).
Stepan et al., "Metabolism-guided drug design", Med. Chem. Commun., vol. 4, pp. 631-652 (2013).
Mascitti et al., "Steroselective Synthesis of a Dioxa-bicyclo[3.2.1]octane SGLT2 Inhibitor", Organic Letters, vol. 12 (13), pp. 2940-2940 (2010).
Bernhardson et al., "Development of an Early-Phase Bulk Enabling Route to Sodium-Dependent Glucose Cotransporter 2 Inhibitor Ertugliflozin", Organic Process Research & Development, vol. 18, pp. 57-65 (2014).
Bowles et al., "Commercial Route Research and Development for SGLT2 Inhibitor Candidate Ertugliflozin", Organic Process Research & Development, vol. 18, pp. 66-81 (2014).
Witczak et al., "A Convenient Synthesis of the (+) Enantiomer of Levoglucosenone and its 5-Hydroxymethyl Analog", Synlett, vol. 1, pp. 108-111 (1996).
Sato et al., "Total Synthesis of the Squalene Synthase Inhibitor Zaragozic Acid C", Synlett, vol. 5, pp. 451-454 (1997).
Paulsen et al., "Syntheseblock B-D-Gal (1→3)-D-GaINAc Zur Selektiv-Simultanen Ankunpfung an Peptide zu O-Glycopeptiden" Tetrahedron Letters, vol. 24(17), pp. 1759-1762 (1983).
Chan et al., "The Squalestatins: C-3 Decarboxylation Studies and Rearrangement to the 6,8-Dioxabicyclo[3.2.1] octane Ring System", Tetrahedron Letters, vol. 34(38), pp. 6143-6146 (1993).
Gurjar et al., "Zaragozic Acid A: Interesting Observations in Anhydro-ring Formation of Densely Functionalised Carbohydrate Templates", Tetrahedron Letters, vol. 35(14), pp. 2241-2244 (1994).
Paterson et al., "Studies Towards the Synthesis of the Zaragozic Acids: A Novel EEpoxide Cyclisation Approach to the Formation of the Bicyclic Acetal Core", Tetrahedron Letters, vol. 37(48), pp. 8803-8806 (1996).
Armstrong et al., "Total Synthesis of (+)-Zaragozic Acid C", Tetrahedron Letters, vol. 39, pp. 3337-3340 (1998).
Chen et al., "Tamden reduction-reductive alkylation of azido sugars", Tetrahedron Letters, vol. 43, pp. 2705-2708 (2002).
Renaudet et al., "Chemoselectively template-assembled glycopeptide presenting clustered cancer related T-antigen", Tetrahedron Letters, vol. 45, pp. 65-68 (2004).
Database CA [Online] Chemical Abstracts Service, Columbus, Ohio, US; Plet, Julien R. H. et al: "Thieme chemistry journal awardees—where are they now? Approaches to tagetitoxin and its decarboxy analogue from D-glucose", XP002742514 retrieved from STN Database accession No. 2010:44961 ; & Plet, et al., "Thieme chemistry journal awardees—where are they now? Approaches to tagetitoxin and its decarboxy analogue from D-glucose", SYNLETT , (20), 3258-3262 CODEN: SYNLES; ISSN: 0936-5214, 2009, DOI: 10.1055/S-0029-1218525.

* cited by examiner

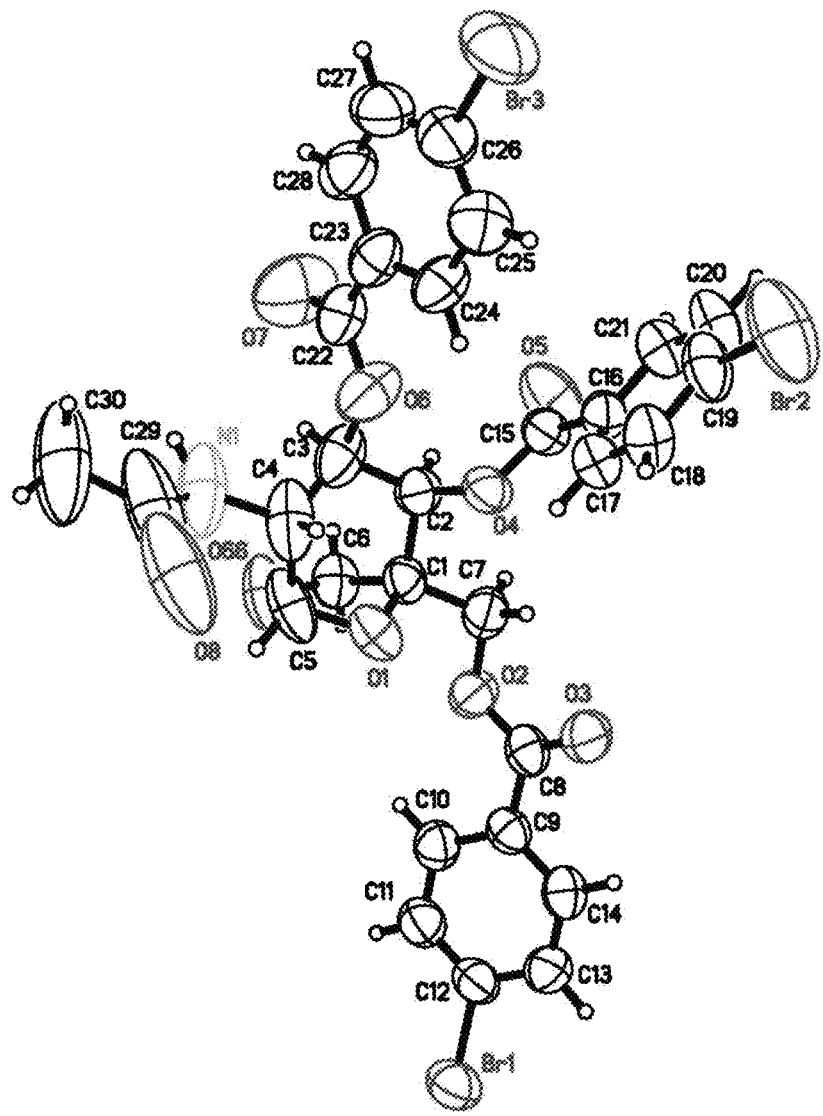

SUBSTITUTED-6,8-DIOXABICYCLO[3.2.1] OCTANE-2,3-DIOL COMPOUNDS AS TARGETING AGENTS OF ASGPR

FIELD OF THE INVENTION

The present invention relates to substituted-6,8-dioxabicyclo[3.2.1]octane-2,3-diol derivatives, crystal structures, pharmaceutical compositions and the uses thereof as asialoglycoprotein receptor (ASGPR) targeting agents.

BACKGROUND

Drug delivery is a serious issue for certain molecular entities and for certain delivery sites. For example, delivery of large molecules, such as an antisense or RNAi molecules, is difficult as such compounds are generally not able to penetrate cell membranes. Moreover, molecular entities that are highly negatively charged and hydrophilic can have restricted diffusion across cell membranes. Furthermore, selective drug delivery to targeted delivery sites is often a challenge because molecules which are cell permeable are often not selective. One solution to cell diffusion and targeted delivery is drug conjugation to targeting agents.

Targeting agents often enhance pharmaceutical attributes including pharmacokinetics and pharmacodynamics. Targeting agents allow the drug payload attached to the targeting agent to be efficiently distributed to and uptaken by specific cells. Certain sugars, such as galactose, N-acetyl galactosamine, and other galactose derivatives including those described by M. G. Finn and V. Mascitti et al. in the Journal of the American Chemical Society, 134, 1978 (2012) have been used as targeting agents for hepatocytes due to the binding to asialoglycoprotein receptors (ASGPR) that are present on the surface of hepatocytes. However, such targeting agents sometimes present some pharmacokinetics problems or may present suboptimal pharmacokinetics profiles.

Intravenous/per oral (IV/PO) pharmacokinetics (PK) studies are done in animal models (generally rats, mice, dogs or non-human primates) or in humans during clinical trials to obtain information on how a drug is absorbed, distributed, metabolized and eliminated in the body. Generally, the drug is formulated with methylcellulose or polyethylene glycol (PEG), sugar and water before administration. Blood samples are taken at different time points for up to 24 hours, usually via the saphenous vein. The blood samples from the dosing arm are pooled, centrifuged and plasma collected. The plasma is diluted so that the concentrations are within the dynamic range of the standard curve (1-5000 ng/mL). The plasma samples are then analyzed for the analyte of interest.

Consequently, there still exists a need for drug delivery agents conducive to improved pharmacokinetics profiles.

SUMMARY

One aspect of the present invention includes compounds of Formula (A)

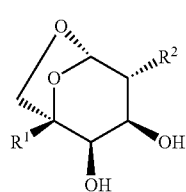

(A)

wherein $R^1$ is —CN, —CH$_2$—CN, —C≡CH, —CH$_2$—N$_3$, —CH$_2$—NH$_2$, —CH$_2$—N(R$^4$)—S(O)$_2$—R$^5$, —CH$_2$—CO$_2$H, —CO$_2$H, —CH$_2$—OH, —CH$_2$—SH, —CH═CH—R$^5$, —CH$_2$—R$^5$, —CH$_2$—S—R$^5$, —CH$_2$—N(R$^4$)—R$^5$, —CH$_2$—N(R$^4$)—C(O)—R$^5$, —CH$_2$—N(R$^4$)—C(O)—O—R$^5$, —CH$_2$—N(R$^4$)—C(O)—N(R$^4$)—R$^5$, —CH$_2$—O—R$^5$, —CH$_2$—O—C(O)—R$^5$, —CH$_2$—O—C(O)—N(R$^4$)—R$^5$, —CH$_2$—O—C(O)—O—R$^5$, —CH$_2$—S(O)—R$^5$, —CH$_2$—S(O)$_2$—R$^5$, —CH$_2$—S(O)$_2$—N(R$^4$)—R$^5$, —C(O)—NH$_2$, —C(O)—O—R$^5$, —C(O)—N(R$^4$)—R$^5$, or aryl or heteroaryl, wherein the aryl or heteroaryl is optionally substituted with R$^5$, or $R^1$ is —Z—X—Y wherein X is a linker or a drug delivery system, Y is absent or is a ligand selected from the group consisting of a small molecule, an amino acid sequence, a nucleic acid sequence, an antibody, an oligomer, a polymer, genetically derived material, a liposome, a nanoparticle, dye, fluorescent probe, or a combination thereof, and Z is absent or is —C≡C—, —CH═CH—, —CH$_2$—, —CH$_2$—O—, —C(O)—N(R$^4$)—, —CH$_2$—S—, —CH$_2$—S(O)—, —CH$_2$—S(O)$_2$—, —CH$_2$—S(O)$_2$—N(R$^4$)—, —C(O)—O—, —CH$_2$—N(R$^4$)—, —CH$_2$—N(R$^4$)—C(O)—, —CH$_2$—N(R$^4$)—S(O)$_2$, —CH$_2$—N(R$^4$)—C(O)—O—, —CH$_2$—N(R$^4$)—C(O)—N(R$^4$)—, —CH$_2$—O—C(O)—, —CH$_2$—O—C(O)—N(R$^4$)—, —CH$_2$—O—C(O)—O—, or aryl or heteroaryl, wherein the aryl or heteroaryl is optionally substituted with R$^5$;

$R^2$ is —OH, —N$_3$, —N(R$^3$)$_2$, —N(R$^3$)—C(O)—R$^3$, —N(R$^3$)—C(O)—N(R$^3$)$_2$, —N(R$^3$)—C(O)—OR$^3$, tetrazole, or triazole, wherein the tetrazole and triazole are optionally substituted with R$^3$ and wherein when $R^1$ is —CH$_2$—OH, $R^2$ is —N$_3$, —N(R$^3$)$_2$, —N(R$^3$)—C(O)—R$^3$, —N(R$^3$)—C(O)—N(R$^3$)$_2$, —N(R$^3$)—C(O)—OR$^3$, tetrazole, or triazole, wherein the tetrazole and triazole are optionally substituted with R$^3$;

each $R^3$ is independently —H, —(C$_1$-C$_5$)alkyl, halo-substituted (C$_1$-C$_5$)alkyl, or (C$_3$-C$_6$)cycloalkyl, wherein a —CH$_2$— group of the alkyl or cycloalkyl may be replaced with a heteroatom group selected from —O—, —S—, and —N(R$^4$)— and —CH$_3$ of the alkyl may be replaced with a heteroatom group selected from —N(R$^4$)$_2$, —OR$^4$, and —S(R$^4$) wherein the heteroatom groups are separated by at least 2 carbon atoms;

each $R^4$ is independently —H, —(C$_1$-C$_{20}$)alkyl, or (C$_3$-C$_6$) cycloalkyl wherein one to six —CH$_2$— groups of the alkyl or cycloalkyl separated by at least two carbon atoms may be replaced with —O—, —S—, or —N(R$^4$)—, and —CH$_3$ of the alkyl may be replaced with a heteroatom group selected from —N(R$^4$)$_2$, —OR$^4$, and —S(R$^4$) wherein the heteroatom groups are separated by at least 2 carbon atoms; and wherein the alkyl and cycloalkyl may be substituted with one to six halo atoms; and each $R^5$ is independently —H, (C$_3$-C$_{20}$)cycloalkyl or (C$_1$-C$_{20}$)alkyl wherein one to six —CH$_2$— groups of the alkyl or cycloalkyl separated by at least two carbon atoms may be replaced with —O—, —S—, or —N(R$^4$)—, and —CH$_3$ of the alkyl may be replaced with a heteroatom group selected from —N(R$^4$)$_2$, —OR$^4$, and —S(R$^4$) wherein the heteroatom groups are separated by at least 2 carbon atoms; and wherein the alkyl and cycloalkyl may be substituted with one to six halo atoms;

or a pharmaceutically acceptable salt thereof.

Another aspect of the present invention includes compound of Formula (A)

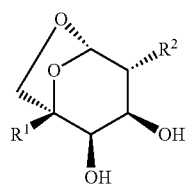

(A)

wherein

R$^1$ is —CN, —CH$_2$—CN, —C≡CH, —CH$_2$—N$_3$, —CH$_2$—NH$_2$, —CH$_2$—N(R$^4$)—S(O)$_2$—R$^5$, —CH$_2$—CO$_2$H, —CO$_2$H, —CH$_2$—OH, —CH$_2$—SH, —CH═CH—R$^5$, —CH$_2$—R$^5$, —CH$_2$—S—R$^5$, —CH$_2$—N(R$^4$)—R$^5$, —CH$_2$—N(R$^4$)—C(O)—R$^5$, —CH$_2$—N(R$^4$)—C(O)—O—R$^5$, —CH$_2$—N(R$^4$)—C(O)—N(R$^4$)—R$^5$, —CH$_2$—O—R$^5$, —CH$_2$—O—C(O)—R$^5$, —CH$_2$—O—C(O)—N(R$^4$)—R$^5$, —CH$_2$—O—C(O)—O—R$^5$, —CH$_2$—S(O)—R$^5$, —CH$_2$—S(O)$_2$—R$^5$, —CH$_2$—S(O)$_2$—N(R$^4$)—R$^5$, —C(O)—NH$_2$, —C(O)—O—R$^5$, —C(O)—N(R$^4$)—R$^5$, or aryl or heteroaryl, wherein the aryl or heteroaryl is optionally substituted with R$^5$, or R$^1$ is —Z—X—Y, —Z—Y, —X—Y, —X, —Y, or —Z—X wherein X is a linker or a drug delivery system, Y is R$^6$ or is a ligand selected from the group consisting of a small molecule, an amino acid sequence, a nucleic acid sequence, an antibody, an oligomer, a polymer, genetically derived material, a liposome, a nanoparticle, dye, fluorescent probe, or a combination thereof, and Z is —C≡C—, —CH═CH—, —CH$_2$—, —CH$_2$—O—, —C(O)—N(R$^4$)—, —CH$_2$—S—, —CH$_2$—S(O)—, —CH$_2$—S(O)$_2$—, —CH$_2$—S(O)$_2$—N(R$^4$)—, —C(O)—O—, —CH$_2$—N(R$^4$)—, —CH$_2$—N(R$^4$)—C(O)—, —CH$_2$—N(R$^4$)—S(O)$_2$—, —CH$_2$—N(R$^4$)—C(O)—O—, —CH$_2$—N(R$^4$)—C(O)—N(R$^4$)—, —CH$_2$—O—C(O)—, —CH$_2$—O—C(O)—N(R$^4$)—, —CH$_2$—O—C(O)—O—, or aryl or heteroaryl, wherein the aryl or heteroaryl is optionally substituted with R$^5$;

R$^2$ is —OH, —N$_3$, —N(R$^3$)$_2$, —N(R$^3$)—C(O)—R$^3$, —N(R$^3$)—C(O)—N(R$^3$)$_2$, —N(R$^3$)—C(O)—OR$^3$, —N(R$^3$)—S(O)$_2$—R$^3$, tetrazole, or triazole, wherein the tetrazole and triazole are optionally substituted with R$^3$ and wherein when R$^1$ is —CH$_2$—OH, R$^2$ is —N$_3$, —N(R$^3$)$_2$, —N(R$^3$)—C(O)—R$^3$, —N(R$^3$)—C(O)—N(R$^3$)$_2$, —N(R$^3$)—C(O)—OR$^3$, N(R$^3$)—S(O)$_2$—R$^3$, tetrazole, or triazole, wherein the tetrazole and triazole are optionally substituted with R$^3$;

each R$^3$ is independently —H, —(C$_1$-C$_5$)alkyl, halo-substituted (C$_1$-C$_5$)alkyl, or (C$_3$-C$_6$)cycloalkyl, wherein one or more —CH$_2$— groups of the alkyl or cycloalkyl may each be replaced with a heteroatom group independently selected from —O—, —S—, and —N(R$^4$)— and —CH$_3$ of the alkyl may be replaced with a heteroatom group selected from —N(R$^4$)$_2$, —OR$^4$, and —S(R$^4$) wherein the heteroatom groups are separated by at least 2 carbon atoms;

each R$^4$ is independently —H, —(C$_1$-C$_{20}$)alkyl, or (C$_3$-C$_6$)cycloalkyl wherein one to six —CH$_2$— groups of the alkyl or cycloalkyl separated by at least two carbon atoms may each be replaced with a heteroatom independently selected from —O—, —S—, or —N(R$^4$)—, and —CH$_3$ of the alkyl may be replaced with a heteroatom group selected from —N(R$^4$)$_2$, —OR$^4$, and —S(R$^4$) wherein the heteroatom groups are separated by at least 2 carbon atoms; and wherein the alkyl and cycloalkyl may be substituted with halo atoms;

each R$^5$ is independently —H, (C$_3$-C$_{20}$)cycloalkyl or (C$_1$-C$_{60}$)alkyl wherein one to six —CH$_2$— groups of the cycloalkyl or one to 20 —CH$_2$— groups of the alkyl may each be replaced with heteroatoms independently selected from —O—, —S—, and —N(R$^4$)— wherein the heteroatoms are separated by at least two carbon atoms, and —CH$_3$ of the alkyl may be replaced with a heteroatom group selected from —N(R$^4$)$_2$, —OR$^4$, and —S(R$^4$) wherein the heteroatom groups are separated by at least 2 carbon atoms; and wherein the alkyl and cycloalkyl may be substituted with halo atoms; and each R$^6$ is independently H, —C≡CH, —C═CH$_2$, —CH$_3$, —N$_3$, —N(R$^4$)$_2$, —OH, —S(O)—(R$^4$), —S(O)$_2$—(R$^4$), —C(O)—OH, —S—S-aryl, —S—S-heteroaryl, heterocycyl, aryl or heteroaryl, wherein each aryl or heteroaryl is optionally substituted with R$^5$;

or a pharmaceutically acceptable salt thereof.

Another aspect of the present invention includes pharmaceutical compositions comprising (i) a compound of Formula (A); and (ii) a pharmaceutically acceptable excipient, diluent, or carrier.

Another aspect of the present invention includes a method for treating a liver disease or condition or a liver modulated disease or condition including hereditary angioedema, familial tyrosinemia type I, Alagille syndrome, Alpha-1-antitrypsin deficiency, Bile acid synthesis and metabolism defects, Biliary Atresia, Cystic Fibrosis liver disease, Idiopathic neonatal hepatitis, Mitochondrial hepatophathies, Progressive familial intrahepatic cholestasis, Primary sclerosing cholangitis, Transthyretin amyloidosis, Hemophilia, Homozygous familial hypercholesterolemia, hyperlipidemia, steatohepatitis, non-alcoholic steatohepatitis (NASH), non-alcoholic fatty liver disease (NAFLD), hyperglycemia like Type II diabetes mellitus, and diseases involving abnormally high hepatic glucose production similar to Type II diabetes mellitus, comprising the administration of an effective amount of a compound according to any of Formula (A) or a pharmaceutically acceptable salt thereof.

Another aspect of the present invention includes compounds of Formula (B)

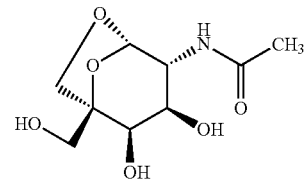 [SMILES: CC(=O)N[C@H]1[C@H]2OC[C@](CO)(O2)[C@H](O)[C@@H]1O]

(B) or a pharmaceutically acceptable salt thereof.

Another aspect of the present invention includes compounds of Formula (C)

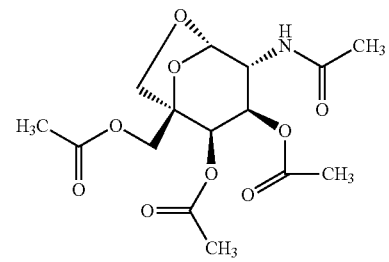 [SMILES: CC(=O)N[C@H]1[C@H]2OC[C@](COC(C)=O)(O2)[C@H](OC(C)=O)[C@@H]1OC(C)=O]

(C) or a pharmaceutically acceptable salt thereof.

Another aspect of the present invention includes compounds of Formula (D)

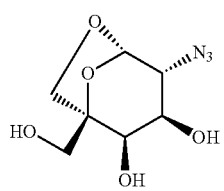 [SMILES: [N-]=[N+]=N[C@H]1[C@H]2OC[C@](CO)(O2)[C@H](O)[C@@H]1O]

(D) or a pharmaceutically acceptable salt thereof.

A further aspect of the present invention includes compounds of Formula (E)

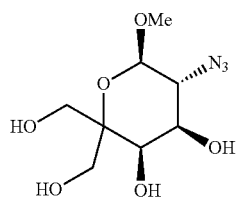

(E) or a pharmaceutically acceptable salt thereof.

Yet a further aspect of the present invention includes compounds of Formula (F)

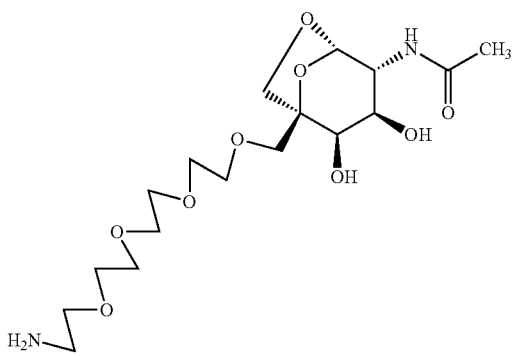 [SMILES: CC(=O)N[C@H]1[C@H]2OC[C@](COCCOCCOCCOCCN)(O2)[C@H](O)[C@@H]1O]

(F) or a pharmaceutically acceptable salt thereof.

Yet a further aspect of the present invention includes compounds of Formula (G)

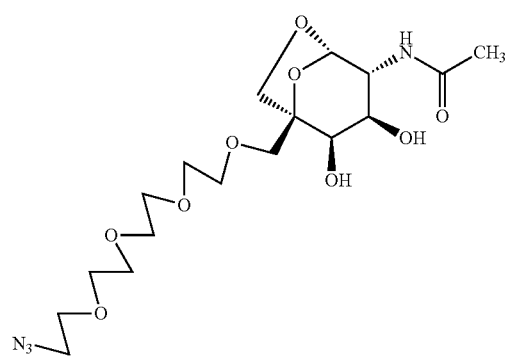 [SMILES: CC(=O)N[C@H]1[C@H]2OC[C@](COCCOCCOCCOCCN=[N+]=[N-])(O2)[C@H](O)[C@@H]1O]

(G) or a pharmaceutically acceptable salt thereof.

A compound of Formula (H)

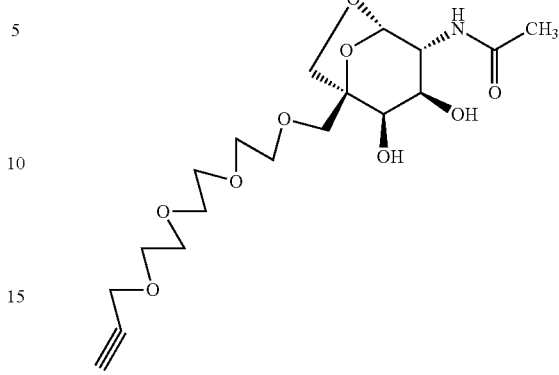

(H) or a pharmaceutically acceptable salt thereof.

It is to be understood that both the foregoing general description and the following detailed description are exemplary and explanatory only and are not restrictive of the invention, as claimed.

BRIEF DESCRIPTION OF THE DRAWINGS

FIG. 1 represents the refined crystal structure for the Example 23 compound which was plotted using the SHELXTL plotting package with ellipsoids drawn at 50% confidence level.

DETAILED DESCRIPTION

The present invention may be understood even more readily by reference to the following detailed description of exemplary embodiments of the invention and the examples included therein.

Before the present compounds, compositions and methods are disclosed and described, it is to be understood that this invention is not limited to specific synthetic methods of making that may of course vary. It is also to be understood that the terminology used herein is for the purpose of describing particular embodiments only and is not intended to be limiting. The plural and singular should be treated as interchangeable, other than the indication of number:

As used herein, the term "alkyl" refers to a hydrocarbon radical of the general formula $C_nH_{2n+1}$. The alkane radical may be straight or branched. For example, the term "$(C_1$-$C_6)$ alkyl" refers to a monovalent, straight, or branched aliphatic group containing 1 to 6 carbon atoms (e.g., methyl, ethyl, n-propyl, i-propyl, n-butyl, i-butyl, s-butyl, t-butyl, n-pentyl, 1-methylbutyl, 2-methylbutyl, 3-methylbutyl, neopentyl, 3,3-dimethylpropyl, hexyl, 2-methylpentyl, and the like). Similarly, the alkyl portion (i.e., alkyl moiety) of an alkoxy, acyl (e.g., alkanoyl), alkylamino, dialkylamino, alkylsulfonyl, and alkylthio group have the same definition as above. When indicated as being "optionally substituted", the alkane radical or alkyl moiety may be unsubstituted or substituted with one or more substituents (generally, one to three substituents except in the case of halogen substituents such as perchloro or perfluoroalkyls) independently selected from the group of substituents listed below in the definition for "substituted." "Halo-substituted alkyl" refers to an alkyl group substituted with one or more halogen atoms (e.g., fluoromethyl, difluoromethyl, trifluoromethyl, perfluoroethyl, 1,1-difluoroethyl and the like).

Similarly, "alkylene" refers to a divalent hydrocarbon radical of the general formula $C_nH_{2n}$ which may be straight or branched.

The term "alkenyl" refers to an univalent unsaturated hydrocarbon radical having one or more carbon-carbon double bonds. The alkenyl moiety may be straight or branched. Exemplary alkenyl groups include ethylenyl. "Alkenylene" as used herein refers to a divalent unsaturated hydrocarbon radical having one or more carbon-carbon double bonds and which may be straight or branched.

The term "alkynyl" refers to an univalent unsaturated hydrocarbon radical having one or more carbon-carbon triple bonds. The alkynyl moiety may be straight or branched. "Alkynylene" as used herein refers to a divalent unsaturated hydrocarbon radical having one or more carbon-carbon triple bonds which may be straight or branched.

The term "aryl" means a carbocyclic aromatic system containing one, two or three rings wherein such rings may be fused. If the rings are fused, one of the rings must be fully unsaturated and the fused ring(s) may be fully saturated, partially unsaturated or fully unsaturated. The term "fused" means that a second ring is present (ie, attached or formed) by having two adjacent atoms in common (ie, shared) with the first ring. The term "fused" is equivalent to the term "condensed". The term "aryl" embraces aromatic radicals such as benzyl, phenyl, naphthyl, tetrahydronaphthyl, indanyl, biphenyl, benzo[b][1,4]oxazin-3(4H)-onyl, 2,3-dihydro-1H indenyl, and 1,2,3,4-tetrahydronaphthalenyl.

The term "cycloalkyl" refers to nonaromatic rings that are fully hydrogenated and may exist as a single ring, bicyclic ring or a spiro ring. Unless specified otherwise, the carbocyclic ring is generally a 3- to 20-membered ring. For example, cycloalkyl include groups such as cyclopropyl, cyclobutyl, cyclopentyl, cyclohexyl, cyclohexenyl, norbornyl (bicyclo[2.2.1]heptyl), bicyclo[2.2.2]octyl, and the like.

The term "heteroaryl" means an aromatic carbocyclic system containing one, two, three or four heteroatoms selected independently from oxygen, nitrogen and sulfur and having one, two or three rings wherein such rings may be fused, wherein fused is defined above. The term "heteroaryl" includes but is not limited to furyl, thienyl, oxazolyl, thiazolyl, imidazolyl, pyrazolyl, triazolyl, tetrazolyl, isoxazolyl, isothiazolyl, oxadiazolyl, thiadiazolyl, pyridinyl, pyridiazinyl, pyrimidinyl, pyrazinyl, pyridin-2(1H)-onyl, pyridazin-2(1H)-onyl, pyrimidin-2(1H)-onyl, pyrazin-2(1H)-onyl, imidazo[1,2-a]pyridinyl, pyrazolo[1,5-a]pyridinyl, 5,6,7,8-tetrahydroisoquinolinyl, 5,6,7,8-tetrahydroquinolinyl, 6,7-dihydro-5H-cyclopenta[b]pyridinyl, 6,7-dihydro-5H-cyclopenta[c]pyridinyl, 1,4,5,6-tetrahydrocyclopenta[c]pyrazolyl, 2,4,5,6-tetrahydrocyclopenta[c]pyrazolyl, 5,6-dihydro-4H-pyrrolo[1,2-b]pyrazolyl, 6,7-dihydro-5H-pyrrolo[1,2-b][1,2,4]triazolyl, 5,6,7,8-tetrahydro-[1,2,4]triazolo[1,5-a]pyridinyl, 4,5,6,7-tetrahydropyrazolo[1,5-a]pyridinyl, 4,5,6,7-tetrahydro-1H-indazolyl and 4,5,6,7-tetrahydro-2H-indazolyl.

The term "drug delivery system" refers to a means of delivering a therapeutically effective amount of a ligand and includes, but is not limited to polymers such as PEG (Poly(ethylene glycol)methyl ether), PEG-PLA (Poly(ethylene glycol)methyl ether-poly(D,L lactide)), PEG-PLGA (Poly(ethylene glycol)methyl ether-poly(lactide-co-glycolide)), and PEG-PCL (Poly(ethylene glycol)-poly(ε-caprolactone) methyl ether), Quantum Dots (Q dots), liposomes, immuno-liposomes, micelles, nanoparticles, and nanogels. Exemplary drug delivery systems are described in Tiwari, G., "Drug Delivery Systems: an Updated Review", Int J Pharm Investig 2 (1) p. 2-11 (January 2012), which is incorporated herein by reference for all purposes.

The term "small molecule" means an organic compound having a molecular weight between 100 and 2,000 daltons, including but not limited to synthetic compounds and natural products.

An "antibody" is an immunoglobulin molecule capable of specific binding to a target, such as a carbohydrate, polynucleotide, lipid, polypeptide, etc., through at least one antigen recognition site, located in the variable region of the immunoglobulin molecule. As used herein, the term encompasses not only intact polyclonal or monoclonal antibodies, but also fragments thereof (such as Fab, Fab', F(ab')2, Fv), single chain (ScFv) and domain antibodies), and fusion proteins comprising an antibody portion, and any other modified configuration of the immunoglobulin molecule that comprises an antigen recognition site. An antibody includes an antibody of any class, such as IgG, IgA, or IgM (or sub-class thereof), and the antibody need not be of any particular class. Depending on the antibody amino acid sequence of the constant domain of its heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA1 and IgA2. The heavy-chain constant domains that correspond to the different classes of immunoglobulins are called alpha, delta, epsilon, gamma, and mu, respectively. The subunit structures and three-dimensional configurations of different classes of immunoglobulins are well known.

As used herein, "monoclonal antibody" refers to an antibody obtained from a population of substantially homogeneous antibodies, i.e., the individual antibodies comprising the population are identical except for possible naturally-occurring mutations that may be present in minor amounts. Monoclonal antibodies are highly specific, being directed against a single antigenic site. Furthermore, in contrast to polyclonal antibody preparations, which typically include different antibodies directed against different determinants (epitopes), each monoclonal antibody is directed against a single determinant on the antigen. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler and Milstein, 1975, Nature 256:495, or may be made by recombinant DNA methods such as described in U.S. Pat. No. 4,816,567. The monoclonal antibodies may also be isolated from phage libraries generated using the techniques described in McCafferty et al., 1990, Nature 348:552-554, for example.

A "variable region" of an antibody refers to the variable region of the antibody light chain or the variable region of the antibody heavy chain, either alone or in combination. As known in the art, the variable regions of the heavy and light chain each consist of four framework regions (FR) connected by three complementarity determining regions (CDRs) that contain hypervariable regions. The CDRs in each chain are held together in close proximity by the FRs and, with the CDRs from the other chain, contribute to the formation of the antigen-binding site of antibodies. There are at least two techniques for determining CDRs: (1) an approach based on cross-species sequence variability (i.e., Kabat et al. Sequences of Proteins of Immunological Interest, (5th ed., 1991, National Institutes of Health, Bethesda Md.)); and (2) an approach based on crystallographic studies of antigen-antibody complexes (Al-lazikani et al, 1997, J. Molec. Biol. 273:927-948). As used herein, a CDR may refer to CDRs defined by either approach or by a combination of both approaches.

As known in the art a "constant region" of an antibody refers to the constant region of the antibody light chain or the constant region of the antibody heavy chain, either alone or in combination.

The phrase "therapeutically effective amount" means an amount of a compound of the present invention that (i) treats the particular disease, condition, or disorder, (ii) attenuates, ameliorates, or eliminates one or more symptoms of the particular disease, condition, or disorder, or (iii) prevents or delays the onset of one or more symptoms of the particular disease, condition, or disorder described herein.

The term "animal" refers to humans (male or female), companion animals (e.g., dogs, cats and horses), food-source animals, zoo animals, marine animals, birds and other similar animal species. "Edible animals" refers to food-source animals such as cows, pigs, sheep and poultry.

The phrase "pharmaceutically acceptable" indicates that the substance or composition must be compatible chemically and/or toxicologically, with the other ingredients comprising a formulation, and/or the mammal being treated therewith.

The terms "treating", "treat", or "treatment" embrace both preventative, i.e., prophylactic, and palliative treatment.

As used herein, "pharmaceutically acceptable carrier" or "pharmaceutical acceptable excipient" includes any material which, when combined with an active ingredient, allows the ingredient to retain biological activity and is non-reactive with the subject's immune system. Examples include, but are not limited to, any of the standard pharmaceutical carriers such as a phosphate buffered saline solution, water, emulsions such as oil/water emulsion, and various types of wetting agents. Preferred diluents for aerosol or parenteral administration are phosphate buffered saline (PBS) or normal (0.9%) saline. Compositions comprising such carriers are formulated by well known conventional methods (see, for example, Remington's Pharmaceutical Sciences, 18th edition, A. Gennaro, ed., Mack Publishing Co., Easton, Pa., 1990; and Remington, The Science and Practice of Pharmacy, 20th Ed., Mack Publishing, 2000).

The term "compounds of the present invention" (unless specifically identified otherwise) refer to compounds of Formula (A), and all enantiomers, tautomers and isotopically labeled compounds. Hydrates and solvates of the compounds of the present invention are considered compositions of the present invention, wherein the compound is in association with water or solvent, respectively. The compounds may also exist in one or more crystalline states, i.e. as co-crystals, polymorphs, or they may exist as amorphous solids. All such forms are encompassed by the claims.

The term "linker" is a chemical group that connects one or more other chemical groups via at least one covalent bond. The linker may include one or more spacing groups including, but not limited to alkylene, alkenylene, alkynylene, alkyl, alkenyl, alkynyl, alkoxy, aryl, heteroaryl, aralkyl, aralkenyl, aralkynyl and the like. The linker may be charge neutral, charge positive or charge negative. In addition, the linker may be cleavable such that the linker's covalent bond that connects the linker to another chemical group within the linker or that bonds to the ligand may be broken or cleaved under certain conditions (see for example H. Bruyere, et al., "Tuning the pH Sensitivities of Orthoester based compounds for Drug Delivery Applications by Simple Chemical Modification", Bioorganic and Medicinal Chemistry Letters, 20, 2200 (2010) and A. A. Kislukhin et al., "Degradable Conjugates from Oxanorbornadiene Reagents", Journal of the American Chemical Society, 134, 6491 (2012). These conditions include pH, temperature, salt concentration, a catalyst, or an enzyme. (G. M. Dubowchik et al., "Cathepsin B-Labile Dipeptide Linkers for Lysosomal Release of Doxorubicin from Internalizing Immunoconjugates: Model Studies of Enzymatic Drug Release and Antigen-Specific In Vitro Anticancer Activity", Bioconjugate Chemistry, 13, 855 (2002), G. Leriche et al., "Cleavable Linkers in Chemical Biology", Bioorganic and Medicinal Chemistry, 20, 571 (2012), C. P. R. Hackenberger et al., "Chemoselective Ligation and Modification Strategies for Peptides and Proteins", Angewandte Chemie International Edition, 47, 10030 (2008); D. M. Patterson et al., "Finding the Right (Bioorthogonal) Chemistry", ACS Chemical Biology, 9, 592 (2014); C. A. Blencowe et al., "Self-immolative Linkers in Polymeric Delivery Systems", Polymer Chemistry, 2, 773 (2011). The disclosures of the above publications are incorporated herein by reference in their entireties for all purposes.

In some embodiments, the linker is cleavable under intracellular conditions, such that the cleavage of the linker releases the ligand unit from the compound of Formula A in the intracellular environment. In some embodiments, the linker is cleavable by a cleaving agent that is present in the intracellular environment (e.g. within a lysosome or endosome or caveolus). One example of a cleavable linker is an enzymatically cleaved linker i.e., a peptidyl linker that is cleaved by an intracellular peptidase or protease enzyme, including but not limited to, a lysosomal or endosomal protease. In some embodiments, the peptidyl linker is at least two amino acids long or at least three amino acids long. Enzymatic cleaving agents include cathepsins B and D and plasmin, all of which are known to hydrolyze dipeptide drug derivatives resulting in the release of active drug inside the target cells (see Dubowchik, Gene M. et al., Cathepsin B-Labile Dipeptide Linkers for Lysosomal Release of Doxorubicin, Bioconjugate Chem. 2002, 13, 855-869). Such linkers include peptides and dipeptides including those described in the above publications which are incorporated herein by reference in their entireties for all purposes.

Other cleavable linkers may be cleaved by nucleophilic/basic reagents, reducing reagents, photo-irradiation, and electrophilic/acidic reagents. (see Leriche, Geoffray, et al., Cleavable Linkers in Chemical Biology, Bioorganic & Medicinal Chemistry 20 (2012) 571-582).

In yet another embodiment, the linker unit is not cleavable and the drug is released by the compound of Formula A by degradation. This process is often referred to as self-immolative elimination, which works by cyclisation or electronic cascade reactions driven by entropy and thermodynamics. One example of a noncleavable linker is a polysubstituted, electron-rich aromatic species with an amino or hydroxyl group or other electron-donating group that is conjugated to a leaving group at a benzylic position (see Blencowe, Christopher A. et al., Self-immolative Linkers in Polymeric Delivery Systems, Polymer Chemistry, 2011, 2, 773-790). Self-immolative elimination linkers include, but are not limited to, aniline based linkers, N-hydroxyaniline based linkers, phenol based linkers, 1,8 elimination based linkers, cyclization based linkers (i.e., hydroxyl based linkers, amino based linkers and thiol based linkers), polymer-dendron conjugates, and polymer conjugates (i.e., N-(2-hydroxypropyl)-methacrylamide (HPMA) polymer conjugates, poly-ethylene glycol (PEG) polymer conjugates) (see I. Tranoy-Opalinski, et al., Design of Self-Immolative Linkers for Tumour-Activated Prodrug Therapy, Anti-Cancer Agents in Medicinal Chemistry, 2008, 8, 618-637; Blencowe, Christopher A. et al., Self-immolative Linkers in Polymeric Delivery Systems, Polymer Chemistry, 2011, 2, 773-790).

Typically, the linker is not substantially cleaved in the extracellular environment. As used herein, "not substantially cleaved in the extracellular environment" in the context of a linker means that no more than 20%, typically no more than about 15%, more typically no more than about 10%, and even more typically no more than about 5%, no more than about 3%, or no more than about 1% of the linkers in a sample of compound of Formula A which includes the X—Y group, are cleaved when the compound is present in an extracellular environment (e.g. plasma). Whether a linker is not substantially cleaved in the extracellular environment can be determined for example by incubating the compound with plasma for a predetermined time period upto 24 hours (e.g. 2, 4, 8, 16 or 24 hours) and then quantitating the amount of free ligand present in the plasma.

The linker may be a monovalent, bivalent or trivalent branched linker. In one embodiment, the linker is a disulfide bridge. In another embodiment, the linker is any of structures L1-L10, which show the linkage to Y and Z (wherein Y and Z represent groups as presented in the summary):

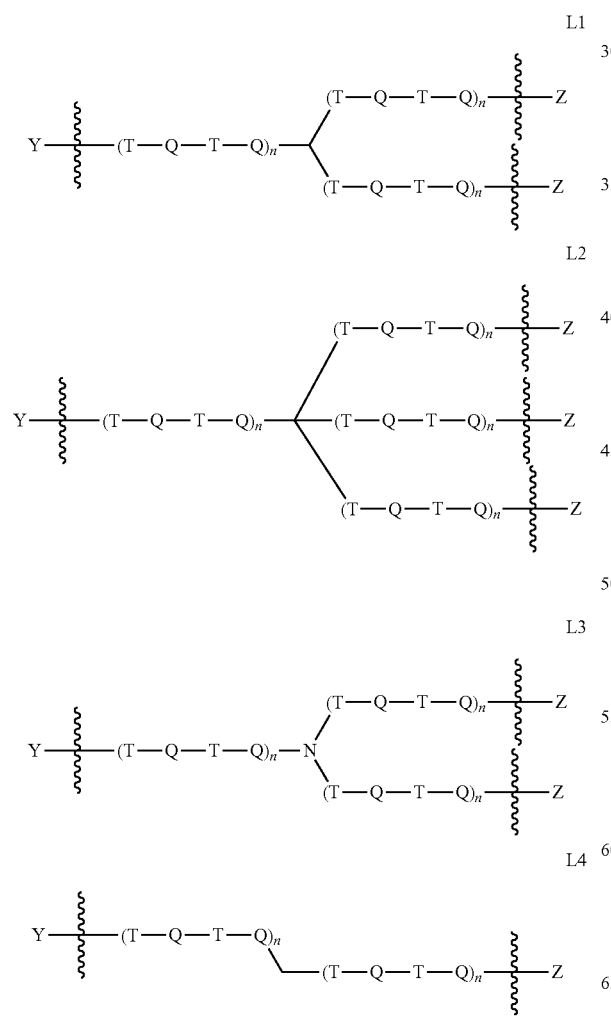

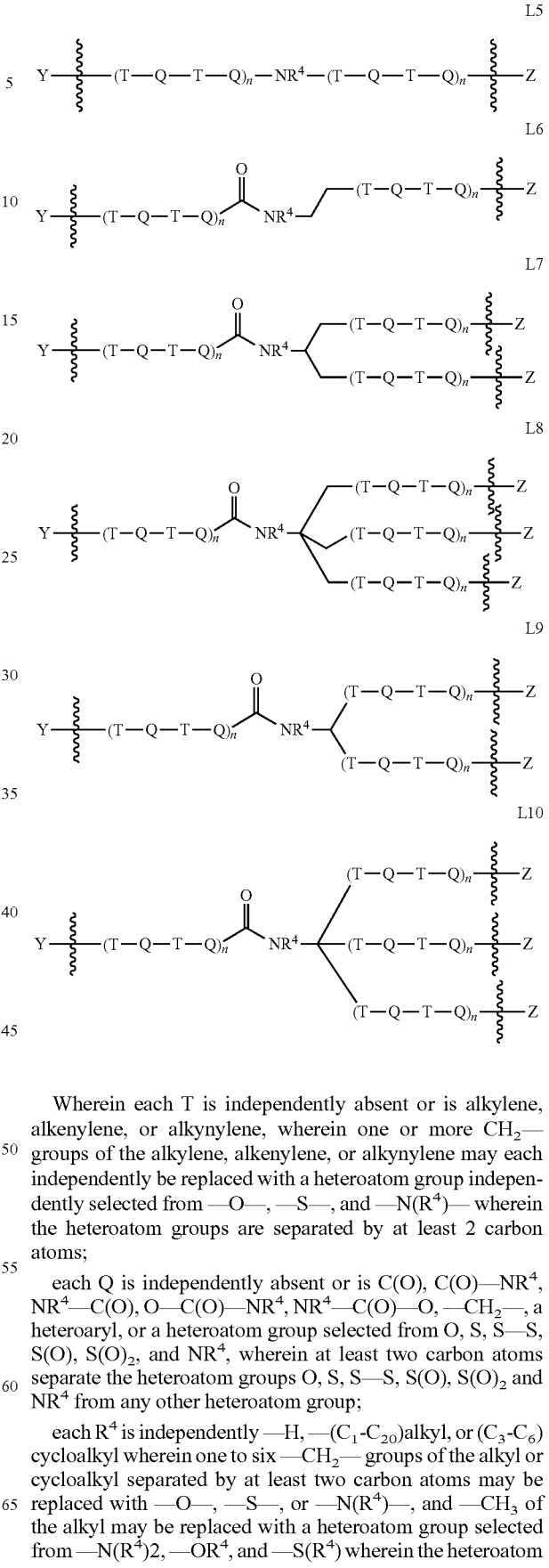

Wherein each T is independently absent or is alkylene, alkenylene, or alkynylene, wherein one or more $CH_2$— groups of the alkylene, alkenylene, or alkynylene may each independently be replaced with a heteroatom group independently selected from —O—, —S—, and —N($R^4$)— wherein the heteroatom groups are separated by at least 2 carbon atoms;

each Q is independently absent or is C(O), C(O)—$NR^4$, $NR^4$—C(O), O—C(O)—$NR^4$, $NR^4$—C(O)—O, —$CH_2$—, a heteroaryl, or a heteroatom group selected from O, S, S—S, S(O), S(O)$_2$, and $NR^4$, wherein at least two carbon atoms separate the heteroatom groups O, S, S—S, S(O), S(O)$_2$ and $NR^4$ from any other heteroatom group;

each $R^4$ is independently —H, —($C_1$-$C_{20}$)alkyl, or ($C_3$-$C_6$) cycloalkyl wherein one to six —$CH_2$— groups of the alkyl or cycloalkyl separated by at least two carbon atoms may be replaced with —O—, —S—, or —N($R^4$)—, and —$CH_3$ of the alkyl may be replaced with a heteroatom group selected from —N($R^4$)2, —$OR^4$, and —S($R^4$) wherein the heteroatom groups are separated by at least 2 carbon atoms; and wherein the alkyl and cycloalkyl may be substituted with halo atoms; and each n is independently 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40. Wherein if n is greater than 1, each T and each Q of each (T-Q-T-Q) is independently selected.

In one embodiment, Q is a heteroaryl selected from 1H-1, 2,3-triazolyl, pryridinyl, and 1,2,3,4-tetrazolyl.

The linker length could be adjusted by the value of n to optimize accessibility to the target molecule. In some cases, the optimal length of the linker could be designed by analysing the drug-target interaction site or the space needed to adequately cleave the compound of Formula (A).

By "genetically derived material" is meant to include proteins (including a Cas9 protein), plasmids (including a plasmid that encodes the Cas9 protein or a cas9 protein and a guide sequence), RNA sequences such as mRNA, siRNA sequences and Cas9 ribonucleoproteins. The Cas9 ribonucleoprotein may comprise two linked or bound elements: (a) a first element comprising a recognition element which may include a tracr mate sequence and at least one guide sequence for insertion upstream of the tracr mate sequence or a single guide sequence (sgRNA), wherein when expressed, the guide sequence directs sequence-specific binding of the Cas9 ribonucleoprotein to a target sequence in a eukaryotic cell, and (b) a second element comprising a Cas9 protein sequence and optionally one or more nuclear localization sequences (NLSs), such as about or more than about 1, 2, 3, 4, 5, 6, 7, 8, 9, 10, or more NLSs. In some embodiments, the second element comprises about 1, 2, 3, 4, 5, 6, 7, 8, 9, or 10 NLSs at or near the amino-terminus, the carboxy-terminus, or a combination of these (e.g. one or more NLS at the amino-terminus and one or more NLS at the carboxy terminus). When more than one NLS is present, each may be selected independently of the others, such that a single NLS may be present in more than one copy and/or in combination with one or more other NLSs present in one or more copies. A "guide sequence" is any polynucleotide sequence having sufficient complementarity with a target polynucleotide sequence to hybridize with the target sequence and direct sequence-specific binding of a Cas9 ribonucleoprotein to the target sequence. Exemplary Cas9 proteins, plasmids, and ribonucleoproteins are described in US20140068797, published on Mar. 6, 2014; US2015031134, published on Jan. 29, 2015; and US2015079681, published on Mar. 19, 2015, all of which are incorporated herein in their entireties for all purposes.

In some embodiments, the guide sequence comprises at least 8 nucleotides where the degree of complementarity between the guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, Calif.), SOAP (available at soap.genomics.org.cn), and Maq (available at maq.sourceforge.net).

Cas9 protein sequences from different species including *S. pneumoniae*, *S. pyogenes*, and *S. thermophilus* exhibit conserved architecture having an HNH homing endonuclease domain and a split RuvC/RNaseH endonuclease domain whereby each Cas9 protein shares 4 primary motifs: motifs 1, 2, and 4, which are RuvC like motifs and motif 3, which is an HNH motif. For *Steptococcus pyogenes* (SEQ ID No:8), motifs 1 is SEQ ID NO:260, motif 2 is SEQ ID NO:261, motif 3 is SEQ ID NO:262, and motif 4 is SEQ ID NO:263. Therefore, by "Cas9 protein sequence" is meant a polypeptide which comprises an amino acid sequence having at least 4 motifs within the sequence which have at least about 75 percent, at least about 80 percent, at least about 85 percent, at least about 90 percent, at least about 95 percent, at least about 99 percent or 100 percent amino acid sequence identity to the motifs 1, 2, 3, and 4 of the Cas9 amino acid sequence of any of SEQ ID NOs:260-263, or to the corresponding portions in any of the amino acid sequences set forth in SEQ ID NOs:1-829. In another embodiment, the Cas9 amino acid sequence is at least about 75 percent, at least about 80 percent, at least about 85 percent, at least about 90 percent, at least about 95 percent, at least about 99 percent or 100 percent amino acid sequence identity to the amino acids at positions 7 to 166 or 731 to 1003 of SEQ ID NO:8 or the corresponding amino acids of those set forth in SEQ ID NOs:1-7, 9-829.

The Cas9 protein sequence may be modified such as being codon-optimized for expression in a eukaryotic cell or to include modifications to the sequence to impact its function. In some embodiments, the Cas9 protein sequence directs cleavage of one or two strands of DNA at the location of the target sequence such as with a Cas9 nickase (i.e., Cas9-D10A) used in combination with guide sequenc(es), e.g., two guide sequences, which target respectively sense and antisense strands of the DNA target thereby allowing both strands to be nicked and resulting in non-homologous end-joining. Cas9-D10A with a single guide sequence can create indels. However, in other embodiments, the Cas9 protein sequence lacks DNA strand cleavage activity such as with selective use of catalytically inactive Cas (dCas) domains. In other embodiments, the Cas9 protein sequence is modified to allow covalent linkage to the Cas9 protein or Cas9 ribonucleoprotein, including lysine and cysteine residue modifications. In yet other embodiments, the Cas9 ribonucleoprotein is capable of directing the cleavage of RNA strands as described in O/'Connell, Mitchell R., et al., Programmable RNA recognition and cleavage by CRISPR/Cas9, Nature, 2014, 516, p 263-266.

Modifications of the Cas9 protein sequence can include a D1OA (aspartate to alanine at amino acid position 10 of SEQ ID NO: 8) mutation (or the corresponding mutation of any of the proteins set forth as SEQ ID NOs: 1-829) that can cleave the complementary strand of the target DNA but has reduced ability to cleave the non-complementary strand of the target DNA (thus resulting in a single strand break instead of a double strand break). Another modification is a H840A (histidine to alanine at amino acid position 840 of SEQ ID NO: 8) mutation (or the corresponding mutation of any of the proteins set forth as SEQ ID NOs:1-829) that can cleave the non-complementary strand of the target DNA but has reduced ability to cleave the complementary strand of the target DNA (thus resulting in a single strand break instead of a double strand break). The use of the D1OA or H840A variant of Cas9 (or the corresponding mutations in any of the proteins set forth as SEQ ID NOs: 1-829) can alter the expected biological outcome because the non-homologous end joining is much more likely to occur when double strand breaks are present as opposed to single strand breaks.

Other residues can be mutated to also inactivate a particular nuclease from motif 1, 2, 3, or 4. As non-limiting examples, residues D10, G12, G17, E762, H840, N854, N863, H982, H983, A984, D986, and/or A987 (or the corresponding mutations of any of the proteins set forth as SEQ ID NOs: 1-829)

can be modified. Mutations can include substitutions, additions, and deletions, or any combination thereof. In some instances, the mutation converts the mutated amino acid to another amino acid, such as alanine. Other modifications include a base modification, a backbone modification, and/or an internucleoside linkage modification.

By "nuclear localization sequence" (NLS) is meant an amino acid sequence which assists the Cas9 ribonucleoprotein to enter the nucleus of a eukaryotic cell. Consequently, an NLS typically comprises one or more short sequences of positively charged lysines or arginines exposed on the protein surface. Exemplary NLSs include, but are not limited to, an NLS sequence derived from: the NLS of the SV40 virus large T-antigen, having the amino acid sequence PKKKRKV (SEQ ID NO: 830); the NLS from nucleoplasmin (e.g. the nucleoplasmin bipartite NLS with the sequence KRPAATKK-AGQAKKKK (SEQ ID NO: 831); the c-myc NLS having the amino acid sequence PAAKRVKLD (SEQ ID NO: 832) or RQRRNELKRSP (SEQ ID NO: 833); the hRNPA1 M9 NLS having the sequence NQSSNFGPMKGGNFGGRSSG-PYGGGGQYFAKPRNQGGY (SEQ ID NO: 834); the sequence RMRIZFKNKGKDTAELRRRRVEVSVEL-RKAKKDEQILKRRNV (SEQ ID NO: 835) of the IBB domain from importin-alpha; the sequences VSRKRPRP (SEQ ID NO: 836) and PPKKARED (SEQ ID NO: 837) of the myoma T protein; the sequence PQPKKKPL (SEQ ID NO: 838) of human p53; the sequence SALIKKKKKMAP (SEQ ID NO: 839) of mouse c-abl IV; the sequences DRLRR (SEQ ID NO: 840) and PKQKKRK (SEQ ID NO: 841) of the influenza virus NS1; the sequence RKLKKKIKKL (SEQ ID NO: 842) of the Hepatitis virus delta antigen; the sequence REKKKFLKRR (SEQ ID NO: 843) of the mouse Mx1 protein; the sequence KRKGDEVDGVDEVAKKKSKK (SEQ ID NO: 844) of the human poly(ADP-ribose) polymerase; the sequence RKCLQAGMNLEARKTKK (SEQ ID NO: 845) of the steroid hormone receptors (human) glucocorticoid; the sequence MAPKKKRKVGIHRGVP (SEQ ID NO:846); and the sequence PKKKRKVEDPKKKRKVD (SEQ ID NO:847).

In one embodiment of a compound of Formula (A), $R^1$ is Z—X—Y and $R^2$ is NH—C(O)—CH$_3$.

In another embodiment of a compound of Formula (A), Y is an RNA sequence.

In yet another embodiment of a compound of Formula (A), Y is an siRNA sequence.

In another embodiment, a compound of Formula (A) is capable of binding to a receptor present on a hepatocyte.

In another embodiment, the receptor present on a hepatocyte is a asialoglycoprotein receptor.

In an embodiment of the pharmaceutical composition, said compound or said therapeutically acceptable salt thereof is present in a therapeutically effective amount.

Compounds of the present invention may be synthesized by synthetic routes that include processes analogous to those well-known in the chemical arts, particularly in light of the description contained herein. The starting materials are generally available from commercial sources such as Aldrich Chemicals (Milwaukee, Wis.) or are readily prepared using methods well known to those skilled in the art (e.g., prepared by methods generally described in Louis F. Fieser and Mary Fieser, *Reagents for Organic Synthesis*, v. 1-19, Wiley, New York (1967-1999 ed.), or *Beilsteins Handbuch der organischen Chemie*, 4, Aufl. ed. Springer-Verlag, Berlin, including supplements (also available via the Beilstein online database)).

For illustrative purposes, the reaction schemes depicted below provide potential routes for synthesizing the compounds of the present invention as well as key synthetic intermediates. For a more detailed description of the individual reaction steps, see the Examples section below. Those skilled in the art will appreciate that other synthetic routes may be used to synthesize the inventive compounds. Although specific starting materials and reagents are depicted in the schemes and discussed below, other starting materials and reagents can be easily substituted to provide a variety of derivatives and/or reaction conditions. In addition, many of the compounds prepared by the methods described below can be further modified in light of this disclosure using conventional chemistry well known to those skilled in the art.

In the preparation of compounds of the present invention, protection of remote functionality (e.g., primary or secondary amine) of intermediates may be necessary. The need for such protection will vary depending on the nature of the remote functionality and the conditions of the preparation methods. Suitable amino-protecting groups (NH-Pg or NPg) include acetyl, trifluoroacetyl, t-butoxycarbonyl (BOC), benzyloxycarbonyl (CBz), 9-fluorenylmethyleneoxycarbonyl (Fmoc), and phthalimide (Pht). A "hydroxy-protecting group" refers to a substituent of a hydroxy group that blocks or protects the hydroxy functionality. Suitable hydroxyl-protecting groups (O-Pg) include for example, allyl, acetyl (Ac), silyl (like trimethylsily (TMS) or tert-butyldimethylsilyl (TBS)), benzyl (Bn), para-methoxybenzyl (PMB), trityl (Tr), para-bromobenzoyl, para-nitrobenzoyl and the like (benzylidene, cyclic ketals, orthoesters, orthoamides for protection of 1,2- or 1,3-diols). The need for such protection is readily determined by one skilled in the art. For a general description of protecting groups and their use, see T. W. Greene, *Protective Groups in Organic Synthesis*, John Wiley & Sons, New York, 1991.

Scheme 1 outlines the general procedures one could use to provide compounds of the present invention. In step 1 of Scheme 1, synthetic intermediate (I-a), that can be prepared by procedures described by H. Paulsen and M. Paal in *Carbohydrate Research*, 135, 53 (1984), is persylilated under classical conditions [using trimethylsilyl chloride and pyridine at room temperature (about 23° C.)] followed by selective cleavage of the trimethyl silyl group protecting the primary alcohol (by treatment under basic conditions such as potassium carbonate in an alcoholic solvent like methanol at a temperature ranging from about −10 degrees Celsius to room temperature) to reveal primary alcohol intermediate (I-b). In step 2 of Scheme 1, the additional hydroxymethylene group found in intermediate (I-c) can be introduced onto the glycoside by means of a Parikh-Doering oxidation described by J. R. Parikh and William v. E. Doering in *Journal of the American Chemical Society*, 89, 5505-5507 (1967) followed by treatment with a formaldehyde source (e.g., solution of formaldehyde in water, solid paraformaldehyde) in the presence of an alkali metal hydroxide (e.g., sodium hydroxide, sodium alkoxide) in water or in an alcoholic solvent at a temperature ranging from about room temperature to about 60 degrees Celsius. This is referred to as an aldol-Cannizzaro reaction. Modifications of this process known to those of skill in the art may also be used. For example, other oxidants, like stabilized 2-iodoxybenzoic acid described by Ozanne, A. et al. in *Organic Letters*, 5, 2903 (2003), the Swern oxidation described in Kanji Omura and Daniel Swern in *Tetrahedron*, 34, 1651 (1978), as well as other oxidants known by those skilled in the art can also be used. The aldol Cannizzaro sequence has been described by Robert Schaffer in the *Journal of The American Chemical Society*, 81, 5452 (1959) and Amigues, E. J., et al., in *Tetrahedron*, 63, 10042 (2007). Experimental conditions of step 2 in Scheme 1 also promote cleavage of the trimethylsilyl groups protecting the secondary alcohols. In step 3 of Scheme 1, intermediate (I-c) is treated with an organic or inorganic acid (e.g., sulfuric acid) or an acidic resin in a solvent like water at a temperature ranging from about room temperature to about 100 degrees Celsius to produce compound (1) of the present invention. In step 4 of Scheme 1, compound (1) can be treated with a reducing agent known to reduce azido groups to the corresponding amine (e.g., transition-metal mediated catalytic hydrogenation, use of triphenylphosphine in water under classical experimental conditions well known by those skilled in the art). Subsequent treatment in presence of an acylating agent (e.g., acetic anhydride or acetyl chloride in presence of pyridine or triethylamine in a solvent such as dichloromethane or tetrahydrofuran at a temperature ranging from 0 to 80 degrees Celsius) provides compound (2) of the present invention. In step 5 of Scheme 1, treatment of compound (2) in presence of an alkoxide (e.g., sodium methoxide) in a solvent, or mixture of solvents, such as an alcoholic solvent or tetrahydrofuran at a temperature ranging from about 0 to room temperature provides compound (3) of the present invention. Furthermore, the compounds thus obtained can then be easily functionalized to other claimed compounds from the present invention using well known protective and functional groups manipulation sequences known by those skilled in the art. Thus, in steps 6 and 7 of Scheme 1, secondary hydroxyl groups in compounds (1) and (3) respectively can be further protected by a suitable protecting group (e.g., as a cyclic ketal upon treatment with 2,2-dimethoxypropane under acidic conditions in a solvent such as N,N-dimethylformamide at a temperature ranging from about room temperature to about 90 degrees Celsius) to access intermediates such as (I-d) and (I-e). In turn, using synthetic transformations and functional and protecting groups manipulations well known by those skilled in the art, (I-d) and (I-e) are primed for further functionalization and derivatization of the primary hydroxyl group to link the desired linker X and ligand Y of interest to produce the XY-containing compounds claimed in the present invention. Removal of the protecting groups (e.g., Pg), using reagents and conditions well known to those skilled in the art (e.g., in the case where the two Pg form a cyclic ketal such as an acetonide, it can be removed under acidic conditions using an acid such as acetic acid in a solvent or mixture of solvents such as acetic acid, an alcoholic solvent, water, tetrahydrofuran at a temperature ranging from room temperature to about 80 degrees Celsius), to reveal the secondary hydroxyl groups leads to XY-containing compounds claimed in the present invention. For example, alkylation of the primary hydroxyl group in (I-e) can lead to, after protecting group manipulation and removal, the corresponding ether-linked XY-containing compounds claimed in this invention. Ester-linked, carbonate-linked and carbamate-linked XY-containing compounds claimed in the present invention can also be conveniently accessed from (3) or intermediate (I-e) using the appropriate reactants and reagents well known by those skilled in the art. Conversion of the primary hydroxyl group in (I-e) to the corresponding triflate (III-e-1) followed by nucleophilic displacement with the appropriate nucleophile can lead to, after protecting group manipulation and removal, the corresponding ether- and thio-ether-linked XY-containing compounds claimed in this invention. Oxidation of the thioether intermediate can also lead to the corresponding sulfoxide- and sulfone-linked XY-containing compounds claimed in this invention. In addition, displacement of the primary triflate in (III-e-1) by potassium thioacetate followed by thioester hydrolysis can provide the corresponding thiol (III-e-2) which provides compound (IV-e-1) of the present invention after protecting group manipulation and removal; further alkylation of the thiol (III-e-2) and protecting group manipulation and removal can also produce thioether-linked XY-containing compounds claimed in this invention. (III-e-2) can also be converted to the corresponding sulfonyl chloride and treated with the appropriate amine to produce, after protecting group manipulation and removal, sulfonamide linked XY-containing compounds of the present invention. Displacement of the primary triflate (III-e-1) with sodium azide can also produce the corresponding azide-containing compound (III-e-3) which after protecting group manipulation and removal provides compound (IV-e-2) of the present invention. Reduction of compound (III-e-3) can produce the corresponding primary amine (III-e-4) primed for further functionalization (e.g., amide bond formation, reductive amination, sulfonamide formation, urea formation, carbamate formation, etc) to link the XY substituent and produce compounds claimed in this invention after protecting group manipulation and removal. (III-e-4) can also produce compound (IV-e-3) of the present invention after protecting group manipulation and removal. Treatment of the above azide intermediate (III-e-3) with an alkyne or nitrile containing reagent or synthetic intermediate followed by protecting group manipulation and removal under conditions well known by those skilled in the art can also produce a triazole- or tetrazole-linked XY-containing compounds claimed in this invention, respectively. Oxidation of the primary hydroxyl group in (I-e) to the corresponding aldehyde (III-e-5) followed by reductive amination, under classical conditions known to those skilled in the art, with the appropriate amine, or olefination (such as Wittig-, Horner-Wadsworth-Emmons-, Petterson, Julia-type and modification thereof) followed by reduction of the olefin formed (using for instance a metal mediated catalytic hydrogenation or a diimide mediated reduction well known by those skilled in the art), can lead to the desired nitrogen- or carbon-linked X—Y-containing compounds claimed in this invention after functional group manipulation and protecting group manipulation and removal, respectively. Conversion of the aldehyde (III-e-5) to the corresponding alkyne (III-e-6) (using a Corey-Fuchs type reaction or using a Seyferth-Gilbert type reagent) followed by protecting group manipulation and removal can lead to compound (IV-e-4) claimed in the present invention. In turn, treatment of alkyne (III-e-6) or (IV-e-4) with an azide containing reagent or synthetic intermediate followed by protecting group manipulation and removal under conditions well known by those skilled in the art can also produce a triazole-linked XY-containing compounds claimed in this invention. Alkyne (III-e-6) can also serve as a useful synthetic intermediate to access other compounds claimed in this invention upon treatment with the appropriate reagents under metal mediated cross couplings known to those skilled in the art (such as a Sonogashira-type reaction). Oxidation of the primary hydroxyl group in (I-e) to the corresponding acid (III-e-7) provides, using synthetic transformations well known by those skilled in the art, access to ester- and amide-linked XY-containing compound claimed in this invention, after protecting group removal. Protecting group manipulation and removal in (III-e-7) also provides readily access to compound (IV-e-5) of the present invention. Conversion of (IV-e-5) or (III-e-7) to the corresponding primary amide under conditions well known by those skilled in the art directly provides compound (IV-e-6) claimed in the present invention or compound (III-e-8) which after protecting group manipulation and removal gives (IV-e-6). In addition, dehydration of the amide functionality in (III-e-8) can provide the corresponding nitrile (III-e-9) which after functional group manipulation and removal provides compound (IV-e-7) of the present invention. Displacement of the primary triflate (III-e-1) with a cyanide anion can also produce the corresponding nitrile-containing compound (III-e-10) which after protecting group manipulation and removal provides compound (IV-e-8) of the present invention. In turn, hydrolysis of the nitrile in (IV-e-8) or (III-e-10) can provide directly access to acid (IV-e-9) or to (III-e-11) which after protecting group manipulation and removal provides (IV-e-9). Alkyne containing compounds such as (III-e-6)/(IV-e-4), primary amide containing compounds such as (III-e-8)/(IV-e-6), nitrile containing compounds such as (III-e-9)/(IV-e-7)/(III-e-10)/(IV-e-8), acid containing compound such as (III-e-7)/(IV-e-5)/(III-e-11)/(IV-e-9), aldehyde containing compounds such as (III-e-5) can also be further functionalized and reacted with the appropriate reagent and synthetic intermediate under conditions well known by those skilled in the art (and summarized in J. A. Joule and K. Mills, *Heterocyclic Chemistry*, 5$^{th}$ edition, Wiley Ed., (2010); J. J. Li, Name *Reactions in heterocyclic chemistry*, Wiley, (2005); M. R. Grimmett *Advances in Heterocyclic Chemistry*, 27, 241, (1981); I. G. Turchi et al., *Chemical Reviews*, 75, 389, (1975); K. T. Potts, *Chemical Reviews*, 61, 87, (1961); R. H. Wiley, *Organic Reactions*, 6, 367, (1951); L. B. Clapp, *Advances in Heterocyclic Chemistry*, 20, 65, (1976); A. Hetzheim et al., *Advances in Heterocyclic Chemistry*, 7, 183, (1967); j. Sandstrom, *Advances in Heterocyclic Chemistry*, 9, 165, (1968); S. J. Wittenberger, *Organic Preparations and Procedures International*, 26, 499, (1994); M. G. Finn et al., Angewandte Chemie International Edition, 48, 9879, (2009)) to produce additional 5 and 6 membered ring (such as isoxazole, isothiazole, pyrazole, oxazole, thiazole, imidazole, 1,2,4-oxadiazole, 1,2,4-thiadiazole, 1,2,4-triazole, 1,3,4-oxadiazole, 1,3,4-thiadiazole, tetrazole, 1,2,3-triazole) linked XY-containing compounds claimed in this invention. Aryl ring-linked XY-containing compounds claimed in this invention can also be accessed from alkynes such as (III-e-6) and (IV-e-4), or a heterosubstituted analogue of these alkynes (i.e., by replacing the alkyne hydrogen in (III-e-6)/(IV-e-4) by OR$^4$, N(R$^4$)$_2$, SW; these compounds can be accessed using conditions and reagents known to those skilled in the art), via a benzannulation reaction known from those skilled in the art (such as a Danheiser-type or Dotz-type benzannulation).

Similar chemistry described above for (3) and (I-e) can also be applied to (1) and intermediate (I-d) to provide additional compounds claimed in the present invention. See examples section for further details.

Scheme 1.

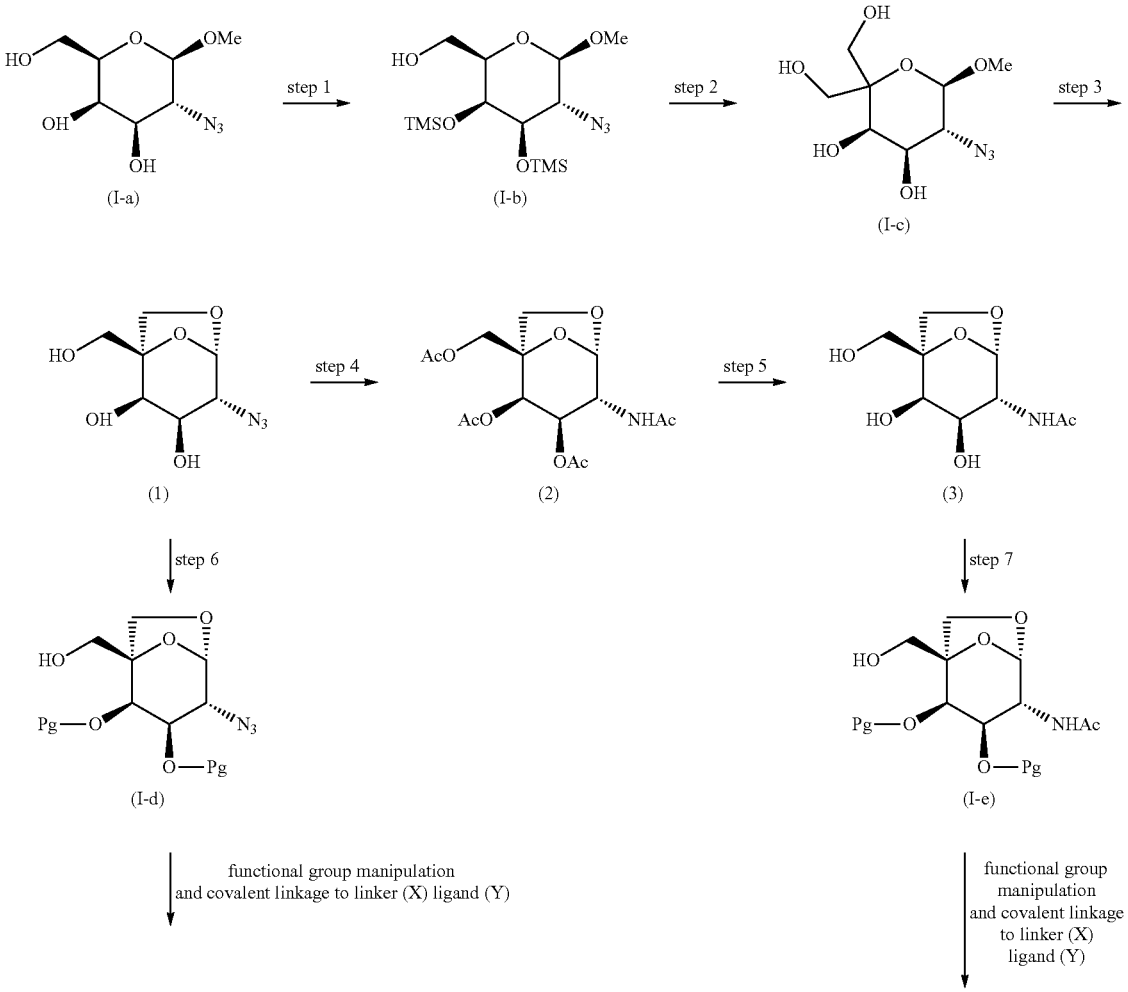

21
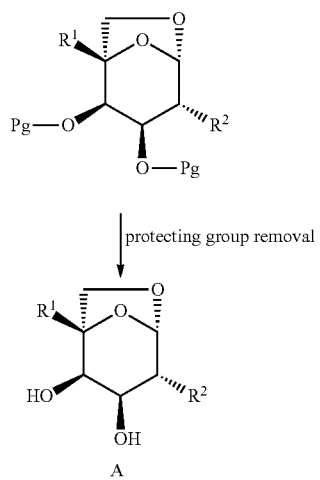
22
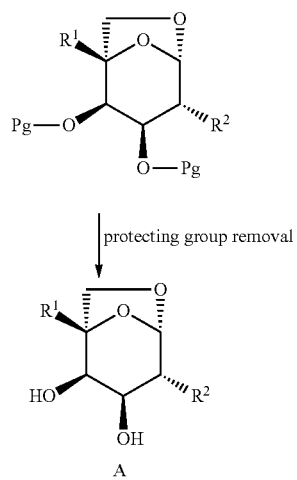
-continued
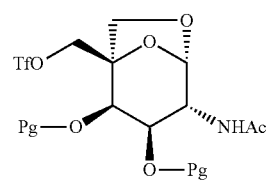 (III-e-1)
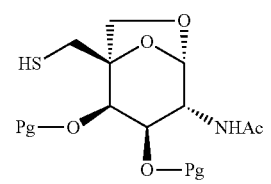 (III-e-2)
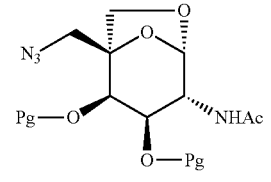 (III-e-3)
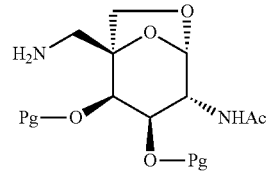 (III-e-4)
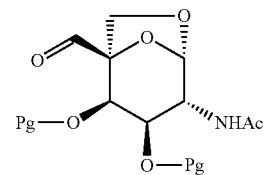 (III-e-5)
-continued
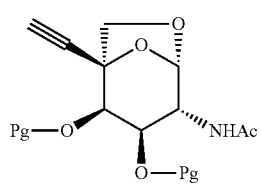 (III-e-6)
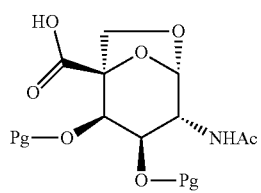 (III-e-7)
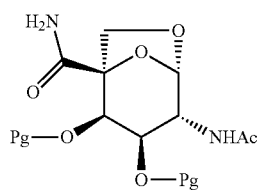 (III-e-8)
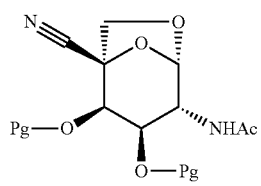 (III-e-9)
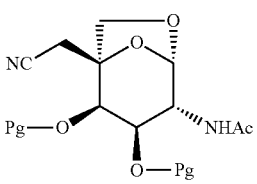 (III-e-10)

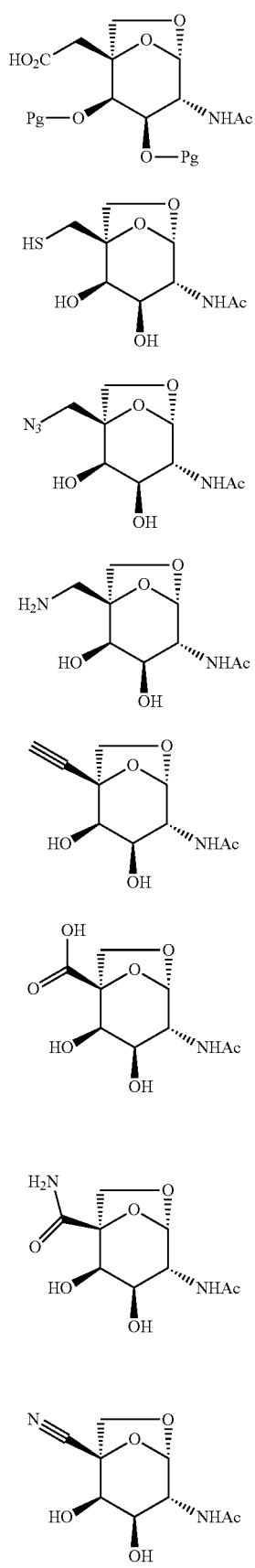

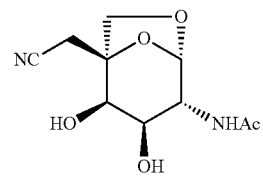

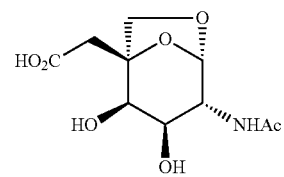

The use of trifluoroacetic anhydride in step 4 of Scheme 1 can also provide access to N-((1S,2R,3R,4R,5S)-2,3-dihydroxy-1-(hydroxymethyl)-6,8-dioxabicyclo[3.2.1]octan-4-yl)-2,2,2-trifluoroacetamide, compound (24) of the present invention.

Alternatively, compounds of the present invention, such as (3), could be prepared by the sequence described in Scheme 2. Thus methyl 2-acetamido-2-deoxy-α-D-galactopyranoside (II-a) could be submitted to an oxidation/Aldo-Cannizzaro protocol, similar to the one already described by A. W. Mazur in EP0341062 (1989), to produce intermediate (II-b). Treatment of (II-b) under conditions already described above and known by those skilled in the art in steps 3 (bridged ketal formation), 4 (acetylation), and 5 (ester hydrolysis) of Scheme 1 provides compound (3). Compound (1) could also be accessed from (I-a) (or its epimer at the anomeric position) using the same approach described in Scheme 2.

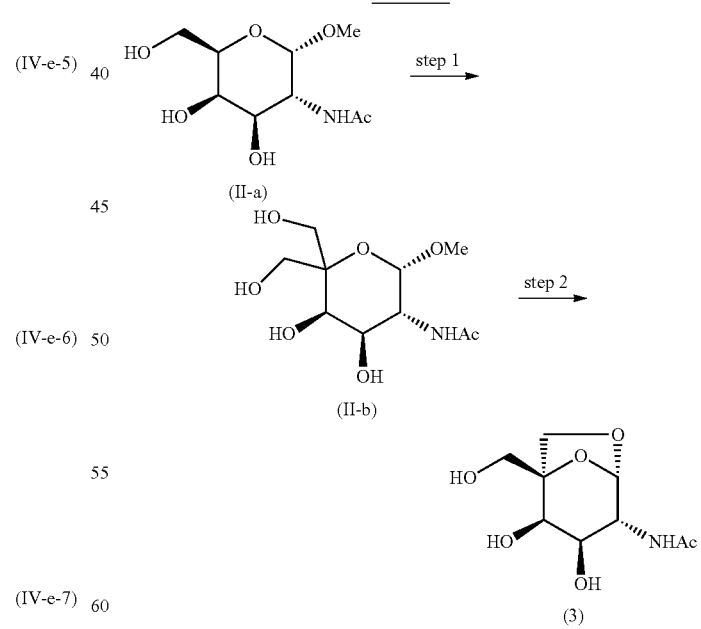

Particularly when R¹ contains an aliphatic-, PEG-derived chain, PEG-derived oligo- or poly-mer, compounds of the present invention can be further functionalized, reacted, and formulated under conditions known to those skilled in the art to access additional compounds claimed in the present invention that can be used and incorporated in the formulation of hepatoselective drug delivery systems such as Biodegradable PLGA-b-PEG polymeric nanoparticles (see, Erica Locatelli et al., *Journal of Nanoparticle Research*, 14, 1316, (2012)) and lipid based platforms such as liposomes, lipid nanoparticles, stable nucleic acids lipid nanoparticles (see, Sara Falsini et al., *Journal of Medicinal Chemistry*, 57, 1138 (2014)).

Diastereomeric mixtures can be separated into their individual diastereoisomers on the basis of their physical chemical differences by methods well known to those skilled in the art, such as by chromatography and/or fractional crystallization, distillation, sublimation.

Enantiomers can be separated by converting the enantiomeric mixture into a diastereomeric mixture by reaction with an appropriate optically active compound (e.g., chiral auxiliary such as a chiral alcohol or Mosher's acid chloride), separating the diastereoisomers and converting (e.g., hydrolyzing) the individual diastereoisomers to the corresponding pure enantiomers. Also, some of the compounds of the present invention may be atropisomers (e.g., substituted biaryls) and are considered as part of this invention. Enantiomers can also be separated by use of a chiral HPLC (high pressure liquid chromatography) column.

It is also possible that the intermediates and compounds of the present invention may exist in different tautomeric forms, and all such forms are embraced within the scope of the invention. The term "tautomer" or "tautomeric form" refers to structural isomers of different energies which are interconvertible via a low energy barrier. For example, proton tautomers (also known as prototropic tautomers) include interconversions via migration of a proton, such as keto-enol and imine-enamine isomerizations. A specific example of a proton tautomer is the imidazole moiety where the proton may migrate between the two ring nitrogens. Valence tautomers include interconversions by reorganization of some of the bonding electrons. The equilibrium between closed and opened form of some intermediates (and/or mixtures of intermediates) is reminiscent of the process of mutarotation involving aldoses, known by those skilled in the art.

The present invention also embraces isotopically-labeled compounds of the present invention which are identical to those recited herein, but for the fact that one or more atoms are replaced by an atom having an atomic mass or mass number different from the atomic mass or mass number usually found in nature. Examples of isotopes that can be incorporated into compounds of the invention include isotopes of hydrogen, carbon, nitrogen, oxygen, phosphorus, sulfur, fluorine, iodine, and chlorine, such as $^{2}H$, $^{3}H$, $^{11}C$, $^{13}C$, $^{14}C$, $^{13}N$, $^{15}N$, $^{15}O$, $^{17}O$, $^{18}O$, $^{31}P$, $^{32}P$, $^{35}S$, $^{18}F$, $^{123}I$, $^{125}I$ and $^{36}Cl$, respectively.

Certain isotopically-labeled compounds of the present invention (e.g., those labeled with $^{3}H$ and $^{14}C$) are useful in compound and/or substrate tissue distribution assays. Tritiated (i.e., $^{3}H$) and carbon-14 (i.e., $^{14}C$) isotopes are particularly preferred for their ease of preparation and detectability. Further, substitution with heavier isotopes such as deuterium (i.e., $^{2}H$) may afford certain therapeutic advantages resulting from greater metabolic stability (e.g., increased in vivo halflife or reduced dosage requirements) and hence may be preferred in some circumstances. Positron emitting isotopes such as $^{15}O$, $^{13}N$, $^{11}C$, and $^{18}F$ are useful for positron emission tomography (PET) studies to examine substrate occupancy. Isotopically labeled compounds of the present invention can generally be prepared by following procedures analogous to those disclosed in the Schemes and/or in the Examples herein below, by substituting an isotopically labeled reagent for a non-isotopically labeled reagent.

Compounds of the present invention are useful for treating diseases, conditions and/or disorders; therefore, another embodiment of the present invention is a pharmaceutical composition comprising a therapeutically effective amount of a compound of the present invention and a pharmaceutically acceptable excipient, diluent or carrier. The compounds of the present invention (including the compositions and processes used therein) may also be used in the manufacture of a medicament for the therapeutic applications described herein.

The compositions of this invention may be in liquid solutions (e.g., injectable and infusible solutions). The preferred form depends on the intended mode of administration and therapeutic application. Typical compositions are in the form of injectable or infusible solutions, such as compositions similar to those used for passive immunization of humans. One mode of administration is parenteral (e.g., intravenous, subcutaneous, intraperitoneal, intramuscular, intradermal, and intrasternally) or by infusion techniques, in the form of sterile injectable liquid or olagenous suspensions. As will be appreciated by the skilled artisan, the route and/or mode of administration will vary depending upon the desired results. In a preferred embodiment, the antibody is administered by intravenous infusion or injection. In another preferred embodiment, the antibody is administered by intramuscular or subcutaneous injection.

Therapeutic compositions typically are sterile and stable under the conditions of manufacture and storage.

The composition can be formulated as a solution, microemulsion, dispersion, or liposome. Sterile injectable solutions can be prepared by incorporating the compound of the present invention in the required amount in an appropriate diluent with one or a combination of ingredients enumerated above, as required, followed by sterilization (e.g., filter sterilization). Generally, dispersions are prepared by incorporating the active compound into a sterile vehicle that contains a basic dispersion medium and the required other ingredients from those enumerated above. Such suspensions may be formulated according to the known art using those suitable dispersing of wetting agents and suspending agents or other acceptable agents. The sterile injectable preparation may also be a sterile injectable solution or suspension in a non-toxic parenterally acceptable diluent or solvent, for example as a solution in 1,3-butanediol. Among the acceptable vehicles and solvents that may be employed are water, Ringer's solution and isotonic sodium chloride solution. In addition, sterile, fixed oils are conventionally employed as a solvent or suspending medium. For this purpose, any bland fixed oil may be employed, including synthetic mono- or diglycerides. In addition, n-3 polyunsaturated fatty acids may find use in the preparation of injectables.

In the case of sterile powders for the preparation of sterile injectable solutions, the preferred methods of preparation are vacuum drying and freeze drying that yields a powder of the active ingredient plus any additional desired ingredient from a previously sterile filtered solution thereof. The proper fluidity of a solution can be maintained, for example, by the use of a coating such as lecithin, by the maintenance of the required particle size in the case of dispersion and by the use of surfactants.

Prolonged absorption of injectable compositions can be brought about by including in the composition an agent that delays absorption, for example, monostearate salts and gelatin or by formulating the composition into prolonged absorption forms such as, depots, liposomes, polymeric microspheres, polymeric gels, and implants.

Other methods for administration of the compound of the present invention described herein include dermal patches that release the medications directly into a subject's skin. Such patches can contain the compound of the present invention in an optionally buffered, liquid solution, dissolved and/or dispersed in an adhesive, or dispersed in a polymer.

The compound may be administered once, but may also be administered multiple times. For example, the compound may be administered from once daily to once every six months or longer. The administering may be on a schedule such as three times daily, twice daily, once daily, once every two days, once every three days, once weekly, once every two weeks, once every month, once every two months, once every three months and once every six months.

The compound may also be administered continuously via a minipump. The compound may be administered at the site of the diseased body part or at a site distant from the site of the diseased body part. The compound may be administered once, at least twice or for at least the period of time until the disease is treated, palliated or cured. The compound generally may be administered for as long as the disease is present. The compound typically would be administered as part of a pharmaceutical composition as described supra.

The compositions of the invention may include a therapeutically effective amount or a prophylactically effective amount of compound of the invention. In preparing the composition, the therapeutically effective amount of the compound present in the composition can be determined, for example, by taking into account the desired dose volumes and mode(s) of administration, the nature and severity of the condition to be treated, and the age and size of the subject.

Exemplary, non limiting dose ranges for administration of the pharmaceutical compositions of the present invention to a subject are from about 0.01 mg/kg to about 200 mg/kg (expressed in terms of milligrams (mg) of compound of Formula (A) administered per kilogram (kg) of subject weight), from about 0.1 mg/kg to about 100 mg/kg, from about 1.0 mg/kg to about 50 mg/kg, from about 5.0 mg/kg to about 20 mg/kg, or about 15 mg/kg. For purposes of the present invention, an average human subject weighs about 70 kg. Ranges intermediate to any of the dosages cited herein, e.g., about 0.02 mg/kg-199 mg/kg, are also intended to be part of this invention. For example, ranges of values using a combination of any of the recited values as upper and/or lower limits are intended to be included.

Dosage regimens can also be adjusted to provide the optimum desired response (e.g., a therapeutic or prophylactic response) by administering several divided doses to a subject over time or the dose can be proportionally reduced or increased as indicated by the exigencies of the therapeutic situation. It is especially advantageous to formulate parenteral compositions in dosage unit form for ease of administration and uniformity of dosage.

Dosage unit form as used herein refers to physically discrete units suited as unitary dosages for the mammalian subjects to be treated; each unit containing a predetermined quantity of active compound calculated to produce the desired therapeutic effect in association with the required pharmaceutical carrier. The specification for the dosage unit forms of the invention are dictated by and directly dependent on (a) the unique characteristics of the compound or portion and the particular therapeutic or prophylactic effect to be achieved, and (b) the limitations inherent in the art of compounding such an antibody for the treatment of sensitivity in individuals.

The liquid compositions of the present invention can be prepared as unit dosage forms. For example, a unit dosage per vial may contain from 1 to 1000 milliliters (mls) of different concentrations of the compound of Formula (A). In other embodiments, a unit dosage per vial may contain about 1 ml, 2 ml, 3 ml, 4 ml, 5 ml, 6 ml, 7 ml, 8 ml, 9 ml, 10 ml, 15 ml, 20 ml, 30 ml, 40 ml, 50 ml or 100 ml of different concentrations of the compound of Formula (A). If necessary, these preparations can be adjusted to a desired concentration by adding a sterile diluent to each vial. The liquid compositions of the present invention can also be prepared as unit dosage forms in sterile bags or containers, which are suitable for connection to an intravenous administration line or catheter.

Another typical formulation is prepared by mixing a compound of the present invention and a carrier, diluent or excipient. Suitable carriers, diluents and excipients are well known to those skilled in the art and include materials such as carbohydrates, waxes, water soluble and/or swellable polymers, hydrophilic or hydrophobic materials, gelatin, oils, solvents, water, and the like. The particular carrier, diluent or excipient used will depend upon the means and purpose for which the compound of the present invention is being applied. Solvents are generally selected based on solvents recognized by persons skilled in the art as safe (GRAS) to be administered to a mammal. In general, safe solvents are non-toxic aqueous solvents such as water and other non-toxic solvents that are soluble or miscible in water. Suitable aqueous solvents include water, ethanol, propylene glycol, polyethylene glycols (e.g., PEG400, PEG300), etc. and mixtures thereof. The formulations may also include one or more buffers, stabilizing agents, surfactants, wetting agents, lubricating agents, emulsifiers, suspending agents, preservatives, antioxidants, opaquing agents, glidants, processing aids, colorants, sweeteners, perfuming agents, flavoring agents and other known additives to provide an elegant presentation of the drug (i.e., a compound of the present invention or pharmaceutical composition thereof) or aid in the manufacturing of the pharmaceutical product (i.e., medicament).

The formulations may be prepared using conventional dissolution and mixing procedures. For example, the bulk drug substance (i.e., compound of the present invention or stabilized form of the compound (e.g., complex with a cyclodextrin derivative or other known complexation agent)) is dissolved in a suitable solvent in the presence of one or more of the excipients described above. The compound of the present invention is typically formulated into pharmaceutical dosage forms to provide an easily controllable dosage of the drug and to give the patient an elegant and easily handleable product.

The pharmaceutical compositions also include solvates and hydrates of the compounds of Formula (I). The term "solvate" refers to a molecular complex of a compound represented by Formula (I) (including pharmaceutically acceptable salts thereof) with one or more solvent molecules. Such solvent molecules are those commonly used in the pharmaceutical art, which are known to be innocuous to the recipient, e.g., water, ethanol, ethylene glycol, and the like, The term "hydrate" refers to the complex where the solvent molecule is water. The solvates and/or hydrates preferably exist in crystalline form. Other solvents may be used as intermediate solvates in the preparation of more desirable solvates, such as methanol, methyl t-butyl ether, ethyl acetate, methyl acetate, (S)-propylene glycol, (R)-propylene glycol, 1,4-butyne-diol, and the like. The crystalline forms may also exist as complexes with other innocuous small molecules, such as L-phenylalanine, L-proline, L-pyroglutamic acid and the like, as co-crystals or solvates or hydrates of the co-crystalline material. The solvates, hydrates and co-crystalline compounds may be prepared using procedures described in PCT Publication No. WO 08/002824, incorporated herein by reference, or other procedures well-known to those of skill in the art.

The pharmaceutical composition (or formulation) for application may be packaged in a variety of ways depending upon the method used for administering the drug. Generally, an article for distribution includes a container having deposited therein the pharmaceutical formulation in an appropriate form. Suitable containers are well-known to those skilled in the art and include materials such as bottles (plastic and glass), sachets, ampoules, plastic bags, metal cylinders, and the like. The container may also include a tamper-proof assemblage to prevent indiscreet access to the contents of the package. In addition, the container has deposited thereon a label that describes the contents of the container. The label may also include appropriate warnings.

Embodiments of the present invention are illustrated by the following Examples. It is to be understood, however, that the embodiments of the invention are not limited to the specific details of these Examples, as other variations thereof will be known, or apparent in light of the instant disclosure, to one of ordinary skill in the art.

EXAMPLES

Unless specified otherwise, starting materials are generally available from commercial sources such as Aldrich Chemicals Co. (Milwaukee, Wis.), Lancaster Synthesis, Inc. (Windham, N.H.), Acros Organics (Fairlawn, N.J.), Maybridge Chemical Company, Ltd. (Cornwall, England), Tyger Scientific (Princeton, N.J.), AstraZeneca Pharmaceuticals (London, England), and Accela ChemBio (San Diego, Calif.).

General Experimental Procedures

NMR spectra were recorded on a Varian Unity™ 400 (available from Varian Inc., Palo Alto, Calif.) at room temperature at 400 MHz for proton. Chemical shifts are expressed in parts per million (delta) relative to residual solvent as an internal reference. The peak shapes are denoted as follows: s, singlet; d, doublet; dd, doublet of doublet; t, triplet; q, quartet; m, multiplet; bs or br.s., broad singlet; 2s, two singlets; br.d., broad doublet. In some cases only representative $^1$H NMR peaks are given. Column chromatography was performed with either Baker™ silica gel (40 microm; J. T. Baker, Phillipsburg, N.J.) or Silica Gel 50 (EM Sciences™, Gibbstown, N.J.) in glass columns or in Flash 40 Biotage™ columns (ISC, Inc., Shelton, Conn.). MPLC (medium pressure liquid chromatography) was performed using a Biotage™ SP purification system or a Combiflash® Companion® from Teledyne™ Isco™, Biotage™ SNAP cartridge KPsil or Redisep Rf silica (from Teledyne™ Isco™) under low nitrogen pressure were used. Except where otherwise noted, all reactions were run under an inert atmosphere of nitrogen gas using anhydrous solvents. Also, except where otherwise noted, all reactions were run at room temperature (~23° C.). When doing TLC (thin layer chromatography), $R_f$ is defined as the ratio of the distance traveled by the compound divided by the distance traveled by the eluent. $R_t$ (retention time). H-Cube® Continuous-flow Hydrogenation Reactor: A bench-top standalone hydrogenation reactor, combining continuous-flow microchemistry with endogenous on-demand hydrogen generation and a disposable catalyst cartridge system.

LC/MS TOF (ESI):

All data were gathered on an Agilent 1100 LC with MSD TOF (Agilent model G1969A) mass spec detectors running with electrospray spray ionization source. The LC instrument includes a binary pump (Agilent model G1312A) with upper pressure limit of 400 bar attached to autosampler (Agilent model G1313A) which uses external try for sample submission. The column compartment (Agilent model G1316A) which is attached to diode array (Agilent model G1315A). The instrument acquisition and data handling was done with Agilent MassHunter TOF/Q-TOF B.02 (B11285) Patches 1.2.3. Elution Conditions: Column: No column was used. Flow Injection: Injection Volume: 1.0 microL; Flow Rate: 0.5 mL/min. Run Time: 1.0 min; Solvent: Methanol (0.1% formic acid and 0.05% ammonium formate). TOF Conditions: Ionization Source: Electrospray spray ionization source in Positive Mode; Gas Temp: 325 C; Drying Gas: 6 L/min; Nebulizer: 50 psg; VCap: 3500V; Mass Range 110-100 m/z; Acquisition Rate: 0.99 spectra/s: Acquisition Time; 1012.8 ms/spectrum. All solvents were of HPLC Chromasolv grade, from Sigma Aldrich (St. Louis, Mo.). A majority of the chemicals and buffers were purchased from Sigma Aldrich, all 97% in purity or higher.

Method C 1.5 minute run LRMS (low resolution mass spectroscopy): Waters Acqity HSS T3, 2.1 mm×50 mm, C18, 1.7 µm; Mobile Phase: A: 0.1% formic acid in water (v/v); Mobile phase B: 0.1% formic acid in acetonitrile (v/v); Flow– 1.25 ml/minute; Initial conditions: A–95%:B–5%; hold at initial from 0.0-0.1 minute; Linear Ramp to A–5%:B–95% over 0.1-1.0 minute; hold at A–5%:B–95% from 1.0-1.1 minute; return to initial conditions 1.1-1.5 minute.

Method C 3.0 minute run LRMS (low resolution mass spectroscopy): Waters Acqity HSS T3, 2.1 mm×50 mm, C18, 1.7 µm; Mobile Phase: A: 0.1% formic acid in water (v/v); Mobile phase B: 0.1% formic acid in acetonitrile (v/v); Flow—1.25 ml/minute; Initial conditions: A—95%:B—5%; hold at initial from 0.0-0.1 minute; Linear Ramp to A—5%: B—95% over 0.1-2.6 minute; hold at A—5%:B—95% from 2.6-2.95 minute; return to initial conditions 2.95-3.0 minute.

Procedures ((2R,3S,4R,5R,6R)-5-azido-6-methoxy-3,4-bis((trimethylsilyl)oxy)tetrahydro-2H-pyran-2-yl)methanol (I-b)

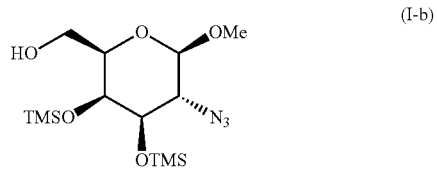

(2R,3R,4R,5R,6R)-5-azido-2-(hydroxymethyl)-6-methoxytetrahydro-2H-pyran-3,4-diol (I-a) (5 g, 23 mmol) was dissolved in anhydrous pyridine (100 mL) and trimethylsilyl chloride (17.5 mL, 139 mmol) was added. The reaction mixture was stirred for 12 hours at room temperature and then pyridine was evaporated. The residue was taken up in ethyl acetate/water. The aqueous phase was extracted once with ethyl acetate and the combined organic layers were washed with water, a saturated aqueous solution of sodium chloride, dried over magnesium sulfate, filtered and concentrated to give 9.9 g (98% yield) of the corresponding per-silylated compound as a yellow oil. The material was used in the next step without any further purification. To a solution of the above per-silylated compound (9.71 g, 22.3 mmol) in anhydrous methanol (45 mL) cooled to 0 degrees Celsius was added 9.06 mL of a solution of potassium carbonate in methanol (0.032M). The reaction mixture was stirred at 0° C. for 1 hour and then neutralized by the addition of 17 microL of acetic acid. The solvent was evaporated and the residue was dissolved in ethyl acetate. Water was added and the aqueous phase was extracted twice with ethyl acetate. The combined organic layers were washed with brine, dried over magnesium sulfate, filtered and concentrated. The crude material was purified by flash chromatography (30% ethyl acetate/hexanes) over silica gel to afford 6.77 g (84%) of (I-b) as an oil. $[\alpha]_D$ 7 (c 1, chloroform); $^1$H NMR (400 MHz, CHLOROFORM-d) delta ppm 0.14 (s, 9H), 0.20 (s, 9H), 1.80 (br. s., 1H), 3.36-3.42 (m, 1H), 3.45 (dd, J=7.3, 4.6 Hz, 1H), 3.54 (dd, J=10.0, 8.0 Hz, 1H), 3.59 (s, 3H), 3.65 (dd, J=11.3, 4.7 Hz, 1H), 3.77 (d, J=2.7 Hz, 1H), 3.87 (dd, J=11.2, 7.3 Hz, 1H), 4.14 (d, J=8.0 Hz, 1H); $^{13}$C NMR (100 MHz, CHLOROFORM-d) delta ppm 0.27 (3C), 0.6 (3C), 57.3, 62.6, 64.0, 71.1, 73.7, 75.2, 103.4; HRMS (ESI) calcd for $C_{13}H_{29}N_3O_5Si_2$ (m/z) [M+Na]$^+$ 386.1538, found 386.1539.

(3R,4R,5R,6R)-5-azido-2,2-bis(hydroxymethyl)-6-methoxytetrahydro-2H-pyran-3,4-diol (I-c)

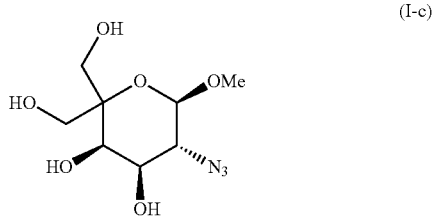 [SMILES: CO[C@@H]1OC(CO)(CO)[C@H](O)[C@H](O)[C@H]1N=[N+]=[N-]]

(I-b) (7.73 g, 21.3 mmol) was dissolved in dichloromethane (70 mL). Dimethyl sulfoxide (10.6 mL, 150 mmol) and triethylamine (9 mL, 60 mmol) were added and the reaction mixture was cooled to 0 degrees Celsius. Sulfur trioxide pyridine complex (10.2 g, 64 mmol) was added and the mixture was stirred at 0 degrees Celsius for 1 hour and then warmed up to room temperature over 30 minutes. The reaction was quenched with a saturated solution of sodium chloride and diluted with dichloromethane. The aqueous phase was extracted 3 times with dichloromethane and the combined organic layers were washed with a saturated aqueous solution of sodium chloride, dried over magnesium sulfate, filtered and concentrated to afford the corresponding aldehyde. The aldehyde was dissolved in anhydrous ethanol (106 mL) and paraformaldehyde powder (40.3 g, 425 mmol) followed by sodium ethoxide 21% wt solution in ethanol (16 mL, 42.5 mmol) were added. The reaction mixture was stirred at room temperature for 12 hours and then ethanol was evaporated. To the crude mixture was added methanol and the solid was filtered and thoroughly rinsed with methanol. To the filtrate containing the desired product was added silica gel and methanol was evaporated. The resulting dry load was dried under high vacuum and loaded on a column. The crude material was purified by flash chromatography (10% methanol/dichloromethane) over silica gel to give 3.03 g of (I-c) as a colorless oil (57% over 2 steps). $[\alpha]_D$ −20 (c 1.25, methanol); $^1$H NMR (400 MHz, METHANOL-d$_4$) delta ppm 3.46 (dd, J=10.2, 8.1 Hz, 1H), 3.51 (s, 3H), 3.64-3.80 (m, 5H), 3.80-3.83 (m, 1H), 4.54 (d, J=8.0 Hz, 1 H); $^{13}$C NMR (100 MHz, METHANOL-d$_4$) delta ppm 57.2, 61.2, 63.6, 65.9, 69.9, 71.2, 80.9, 101.2; HRMS (ESI) calcd for $C_8H_{15}N_3O_6$ (m/z) [M+Na]$^+$ 272.0853, found 272.0856.

N-((3aR,4S,7S,8R,8aR)-4-(hydroxymethyl)-2,2-dimethylhexahydro-4,7-epoxy[1,3]dioxolo[4,5-d]oxepin-8-yl)acetamide (I-e-1)

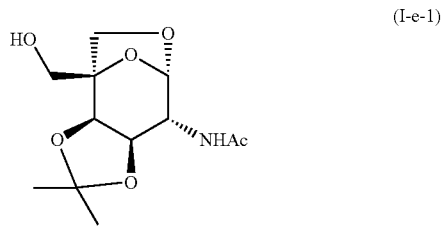 [SMILES: CC(=O)N[C@H]1[C@H]2OC[C@](CO)(O2)[C@@H]2OC(C)(C)O[C@H]12]

To a solution of compound (3) (230 mg, 0.986 mmol) in 6.6 mL of dimethylformamide was added 2,2-dimethoxypropane (0.8 mL, 6 mmol) followed by (+/−)-camphor-10-sulphonic acid (101 mg, 0.435 mmol). The reaction mixture was stirred at 70 degrees Celsius for 24 hours, cooled down to room temperature and then methanol was added (1.2 mL). The reaction mixture was stirred at room temperature for 30 minutes and then neutralized with triethylamine (56 microL). The solvent was evaporated and the residue was coevaporated 3 times with toluene. The crude material was purified by flash chromatography (15/1 ethyl acetate/methanol) over silica gel to afford compound (I-e-1) as a white solid (246 mg, 91% yield). m.p.: 164.7-166.0° C.; $[\alpha]_D$ 147 (c 1, methanol); $^1$H NMR (400 MHz, METHANOL-d$_4$) delta ppm 1.34 (s, 3H), 1.48 (s, 3H), 1.98 (s, 3H), 3.77 (d, J=7.8 Hz, 1H), 3.83 (d, J=7.8 Hz, 1H), 3.86 (d, J=11.6 Hz, 1H), 3.90 (d, J=11.3 Hz, 1H), 3.91-3.94 (m, 1H), 4.14-4.19 (m, 1H), 4.29 (d, J=6.0 Hz, 1H), 5.23 (d, J=2.0 Hz, 1H); $^{13}$C NMR (100 MHz, METHANOL-d$_4$) delta ppm 22.7, 26.9, 28.5, 56.8, 61.9, 70.2, 76.1, 76.6, 83.0, 102.6, 112.5, 173.6; HRMS (ESI) calcd for $C_{12}H_{19}NO_6$ (m/z) [M+H]$^+$ 274.1285, found 274.1274.

(1S,2R,3R,4R,5S)-4-azido-1-(hydroxymethyl)-6,8-dioxabicyclo[3.2.1]octane-2,3-diol (1)

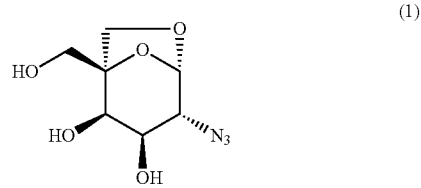 [SMILES: [N-]=[N+]=N[C@H]1[C@H]2OC[C@](CO)(O2)[C@H](O)[C@@H]1O]

The tetra-ol (I-c) (3 g, 12 mmol) was dissolved in water (40 mL) and concentrated sulfuric acid (6.7 mL) was added. The reaction mixture was stirred at 100 degrees Celsius for 40 hours, cooled to room temperature, and then neutralized by the addition of concentrated ammonium hydroxide. Water was evaporated and methanol was added to the resulting mixture. The solid was filtered and thoroughly rinsed with methanol. To the filtrate containing the desired product was added silica gel and methanol was evaporated. The resulting dry load was dried under high vacuum and loaded on a column. The crude material was purified by flash chromatography (10% methanol/dichloromethane) over silica gel to give 2.2 g (84%) of (1) as a colorless oil. [α]$_D$ 160 (c 1.1, methanol); $^1$H NMR (400 MHz, METHANOL-d$_4$) delta ppm 3.35 (dd, J=9.2, 1.6 Hz, 1H), 3.70 (d, J=8.2 Hz, 1H), 3.76 (d, J=8.0 Hz, 1H), 3.80 (d, J=11.3 Hz, 1H), 3.83-3.89 (m, 2H), 3.90 (d, J=11.5 Hz, 1H), 5.32 (d, J=1.4 Hz, 1H); $^{13}$C NMR (100 MHz, METHANOL-d$_4$) delta ppm 61.9, 66.1, 69.5, 69.6, 71.0, 85.3, 102.7; HRMS (ESI) calcd for C$_7$H$_{11}$N$_3$O$_5$ (m/z) [M+Na]$^+$ 240.0591, found 240.0596.

(1R,2R,3R,4R,5S)-4-acetamido-1-(acetoxymethyl)-6,8-dioxabicyclo[3.2.1]octane-2,3-diyl diacetate (2)

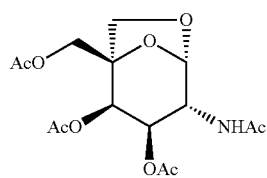

(2)

In a round bottom flask, compound (1) (1.93 g, 8.9 mmol) was dissolved in ethanol (45 mL) and the system was flushed with nitrogen. Lindlar catalyst (1.89 g, 0.9 mmol) was added and the system was flushed with nitrogen and then with hydrogen. The reaction mixture was stirred at room temperature under an atmosphere of hydrogen (using a balloon) for 24 hours. The palladium was filtered using a nylon membrane and thoroughly rinsed with methanol and then water. Solvent was evaporated and the residue was dissolved in water and lyophilized. The resulting crude material was then dissolved in pyridine (40 mL) and acetic anhydride was added (9 mL, 100 mmol). The reaction mixture was stirred at room temperature for 48 hours and the pyridine was evaporated. The residue was dissolved in ethyl acetate and washed with a saturated solution of sodium bicarbonate. The aqueous phase was extracted twice with ethyl acetate and then the combined organic layers were washed with a saturated aqueous solution of sodium chloride, dried over magnesium sulfate, filtered and evaporated. The crude material was purified by flash chromatography (3% methanol/dichloromethane) over silica gel to give (2) (3.19 g, quant.). [α]$_D$ 75 (c 1, chloroform); $^1$H NMR (400 MHz, METHANOL-d$_4$) delta ppm 1.95 (s, 3H), 1.95 (s, 3H), 2.04 (s, 3H), 2.15 (s, 3H), 3.75 (d, J=8.6 Hz, 1H), 4.06 (d, J=8.6 Hz, 1H), 4.13 (d, J=11.6 Hz, 1H), 4.20 (d, J=10.6 Hz, 1H), 4.46 (d, J=11.3 Hz, 1H), 5.13 (dd, J=10.4, 4.4 Hz, 1H), 5.35 (d, J=1.0 Hz, 1H), 5.38 (d, J=4.3 Hz, 1H); $^{13}$C NMR (100 MHz, METHANOL-d$_4$) delta ppm 20.6, 20.7 (2C), 22.6, 53.3, 63.0, 68.9, 69.1, 70.3, 82.6, 103.0, 171.8, 171.9, 172.1, 173.8; HRMS (ESI) calcd for C$_{15}$H$_{21}$NO$_9$ (m/z) [M+H]$^+$ 360.1289, found 360.1290.

N-((1S,2R,3R,4R,5S)-2,3-dihydroxy-1-(hydroxymethyl)-6,8-dioxabicyclo[3.2.1]octan-4-yl)acetamide (3)

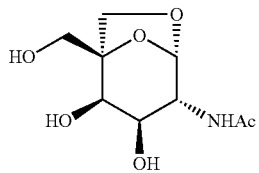

(3)

Compound (2) (3.19 g, 8.88 mmol) was dissolved in tetrahydrofuran (50 mL) and sodium methoxide 0.5M in methanol (100 mL, 50 mmol) was added. The reaction mixture was stirred at room temperature for 12 hours and then neutralized by the addition of H$^+$ Amberlyte™ IR-120 resin. The resin was filtered and solvent was evaporated to give 1.71 g of (3) as a white solid (83%). m.p.: 175.7-176.1° C.; [α]$_D$ 164 (c 1, methanol); $^1$H NMR (400 MHz, METHANOL-d$_4$) delta ppm 1.99 (s, 3H), 3.68 (d, J=8.1 Hz, 1H), 3.70-3.73 (m, 1H), 3.75 (d, J=7.8 Hz, 1H), 3.81 (d, J=11.3 Hz, 1H), 3.87 (d, J=4.3 Hz, 1H), 3.92 (d, J=11.3 Hz, 1H), 3.95 (dd, J=9.9, 1.1 Hz, 1H), 5.22 (d, J=1.3 Hz, 1 H); $^{13}$C NMR (100 MHz, METHANOL-d$_4$) delta ppm 22.7, 56.4, 62.1, 69.2, 69.3, 70.6, 85.1, 102.8, 174.1; HRMS (ESI) calcd for C$_9$H$_{15}$NO$_6$ (m/z) [M+H]$^+$ 234.0972, found 234.0974.

benzyl (4-((2-((1-(1-((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)ethyl)amino)-4-oxobutyl)carbamate (4), benzyl (4-((1,3-bis((1-(1-((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)propan-2-yl)amino)-4-oxobutyl)carbamate (5), benzyl (4-((1,3-bis((1-(1-((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)-2-(((1-(1-((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)methyl)propan-2-yl)amino)-4-oxobutyl)carbamate (6)

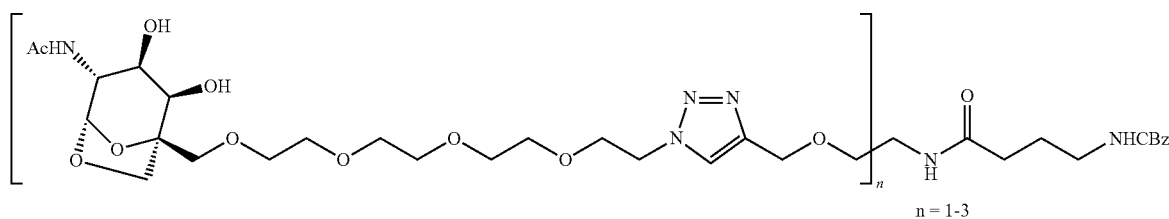

n = 1-3

(4) n = 1
(5) n = 2
(6) n = 3

(I-e-2)

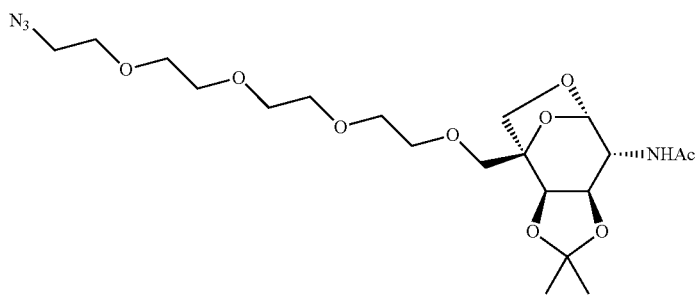

In a microwave vial was dissolved compound (I-e-1) (50 mg, 0.18 mmol) in 1 mL of dichloromethane. 12.5M aqueous sodium hydroxide (0.5 mL) was added followed by 15-crown-5-ether (5 microL, 0.02 mmol) and 1-azido-2-(2-(2-(2-iodoethoxy)ethoxy)ethoxy)ethane (described in *J. Am. Chem. Soc.* 132, 1523 (2010)) (301 mg, 0.915 mmol). The reaction mixture was vigorously stirred at 55° C. for 24 hours. The organic phase was removed and dried over magnesium sulfate, filtered and concentrated. The crude material was purified by flash chromatography (5% methanol/ethyl acetate) over silica gel to afford compound (I-e-2) as an oil (52 mg, 60% yield). $[\alpha]_D$ 74 (c 1, chloroform); $^1$H NMR (400 MHz, METHANOL-$d_4$) delta ppm 1.34 (s, 3H), 1.49 (s, 3H), 1.98 (s, 3H), 3.37 (t, J=4.9 Hz, 2H), 3.62-3.71 (m, 14H), 3.75-3.80 (m, 2H), 3.86 (d, J=8.1 Hz, 1H) 3.90-3.97 (m, 2H), 4.12-4.19 (m, 1H), 4.31 (d, J=5.8 Hz, 1H), 5.23 (d, J=2.0 Hz, 1H); $^{13}$C NMR (100 MHz, METHANOL-$d_4$) delta ppm 22.7, 26.9, 28.5, 51.9, 56.7, 70.9, 71.1, 71.3, 71.6, 71.7, 71.8, 71.81, 71.82, 72.7, 76.1, 76.5, 82.1, 102.4, 112.4, 173.6; HRMS (ESI) calcd for $C_{20}H_{34}N_4O_9$ (m/z) $[M+H]^+$ 475.2399, found 475.2386.

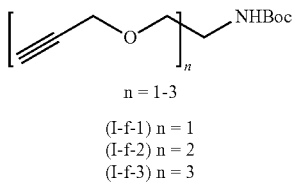

n = 1-3

(I-f-1) n = 1
(I-f-2) n = 2
(I-f-3) n = 3

Intermediate (14-1) is known and is described in WO06120545.

Intermediate (14-2) can be synthesized as follow: To a solution of Boc-serinol (1000 mg, 5.1 mmol) in tetrahydrofuran (21 mL) was added at room temperature tetrabutylammonium iodide (287 mg, 0.76 mmol), sodium iodide (153 mg, 1.02 mmol) and propargyl bromide (1.8 mL, 16 mmol, 80% in toluene). Potassium hydroxide (569 mg, 10.1 mmol) was added portion wise over 30 minutes and then the mixture was stirred at room temperature for 16 hours. The reaction mixture was diluted with ethyl acetate and water. The aqueous phase was extracted once with ethyl acetate. The combined organic layers were dried over magnesium sulfate, filtered and concentrated. The crude material was purified by flash chromatography (30% ethyl acetate/hexanes) over silica gel to afford compound (I-f-2) as an oil (530 mg, 39% yield). $^1$H NMR (400 MHz, CHLOROFORM-d/TMS) delta ppm 1.44 (s, 9H), 2.44 (t, J=2.4 Hz, 2H), 3.53-3.67 (m, 4H), 3.92 (br. s., 1H), 4.16 (d, J=2.5 Hz, 4H), 4.90 (br. s., 1H); $^{13}$C NMR (100 MHz, CHLOROFORM-d/TMS) delta ppm 28.4 (30), 49.5, 58.5 (2C), 68.6 (2C), 74.6 (2C), 77.2, 79.5 (2C), 155.4; HRMS (ESI) calcd for $C_{14}H_{21}NO_4$ (m/z) $[M+H]^+$ 268.1543, found 268.1536. Intermediate (I-f-3) is known and is described in R. Roy et al. J. Org. Chem. 73, 5602 (2008).

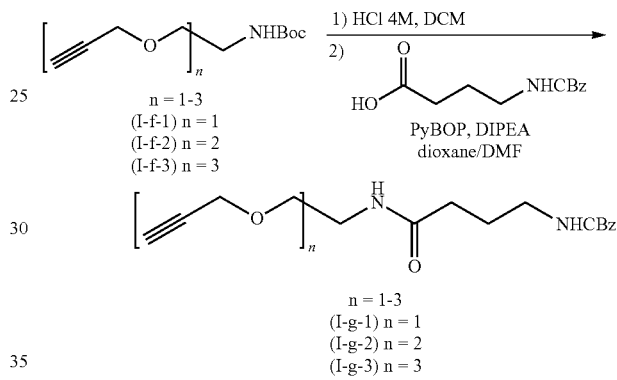

Compound (I-f-1), (I-f-2), or (I-f-3) (1 equiv.) was dissolved in dichloromethane (0.2M) and hydrogen chloride 4M in dioxane (5 to 10 equiv.) was added. The reaction mixture was stirred at room temperature for 2-3 hours and then the solvent was evaporated. The residue was dried under high vacuum for 1 hour. The resulting intermediate was used in the next step without any further purification. The above resulting intermediate (1 equiv.) and 4-(((benzyloxy)carbonyl)amino) butanoic acid (1 equiv.) were dissolved in a mixture of dioxane and dimethylformamide (0.09M, 3:1). (Benzotriazol-1-yloxy)tripyrrolidinophosphonium hexafluorophosphate (1.2 equiv.) was added followed by N,N-diisopropylethylamine (5 equiv.). The reaction mixture was stirred at room temperature for 16 hours. Dichloromethane and water were added and the aqueous phase was extracted twice with dichloromethane. The combined organic layers were dried over magnesium sulfate, filtered and concentrated. The crude material was dissolved in a minimum amount of toluene, loaded on a column and purified by flash chromatography over silica gel.

Intermediate (I-g-1): Purification conditions: 100% ethyl acetate, quantitative, oil. $^1$H NMR (400 MHz, CHLOROFORM-d/TMS) delta ppm 1.80-1.91 (m, 2H), 2.24 (t, J=7.1 Hz, 2H), 2.46 (t, J=2.3 Hz, 1H), 3.22-3.31 (m, 2H), 3.43-3.51 (m, 2H), 3.56-3.64 (m, 2H), 4.16 (d, J=2.3 Hz, 2H), 5.07 (br. s., 1H), 5.10 (s, 2H), 6.09 (br. s., 1H), 7.28-7.42 (m, 5H); $^{13}$C NMR (100 MHz, CHLOROFORM-d/TMS) delta ppm 25.9, 33.7, 39.1, 40.5, 58.3, 66.7, 68.7, 74.8, 79.4, 128.1, 128.5 (40), 136.6, 156.7, 172.5; HRMS (ESI) calcd for $C_{17}H_{22}N_2O_4$ (m/z) $[M+H]^+$ 319.1652, found 319.1646.

Intermediate (I-g-2): Purification conditions: 70% ethyl acetate/hexanes, 65 mg, oil (76% yield), oil. $^1$H NMR (400 MHz, CHLOROFORM-d/TMS) delta ppm 1.79-1.91 (m, 2H), 2.24 (t, J=7.1 Hz, 2H), 2.44 (t, J=2.4 Hz, 2H), 3.20-3.29 (m, 2H), 3.54-3.69 (m, 4H), 4.16 (d, J=1.5 Hz, 4H), 4.22-4.33 (m, 1H), 5.10 (br. s, 3H), 6.04 (d, J=7.8 Hz, 1H), 7.28-7.42 (m, 5H); $^{13}$C NMR (100 MHz, CHLOROFORM-d/TMS) delta ppm 25.8, 33.7, 40.4, 48.2, 58.4 (2C), 66.6, 68.3 (2C), 74.7 (2C), 79.4 (2C), 128.1, 128.5 (40), 136.6, 156.6, 172.2; HRMS (ESI) calcd for $C_{21}H_{26}N_2O_5$ (m/z) [M+H]$^+$ 387.1914, found 387.1904.

Intermediate (I-g-3): Purification conditions: 70% ethyl acetate/hexanes, 42 mg, oil (60% yield). $^1$H NMR (400 MHz, CHLOROFORM-d) delta ppm 1.76-1.88 (m, 2H), 2.21 (t, J=7.1 Hz, 2H), 2.44 (t, J=2.3 Hz, 3H), 3.18-3.30 (m, 2H), 3.84 (s, 6H), 4.14 (d, J=2.3 Hz, 6H), 5.10 (s, 2H), 5.12 (br. s., 1H), 5.89 (br. s., 1H), 7.28-7.40 (m, 5H); $^{13}$C NMR (100 MHz, CHLOROFORM-d/TMS) delta ppm 25.7, 34.3, 40.3, 58.6 (30), 59.2, 66.6, 68.5 (30), 74.6 (30), 79.5 (30), 128.1, 128.5 (40), 136.6, 156.6, 172.6; HRMS (ESI) calcd for $C_{25}H_{30}N_2O_6$ (m/z) [M+H]$^+$ 455.2177, found 455.2167.

to afford the desired compound (I-h-1) as an oil (54 mg, 76% yield); $[\alpha]_D$ 48.2 (c 0.54, methanol); $^1$H NMR (400 MHz, METHANOL-d$_4$) delta ppm 1.33 (s, 3H), 1.48 (s, 3H), 1.70-1.83 (m, 2H), 1.98 (s, 3H), 2.21 (t, J=7.4 Hz, 2H), 3.13 (t, J=6.9 Hz, 2H), 3.37 (t, J=5.4 Hz, 2H), 3.51-3.70 (m, 14H), 3.71-3.95 (m, 7H), 4.15 (t, J=6.5 Hz, 1H), 4.29 (d, J=5.8 Hz, 1H), 4.56 (t, J=5.0 Hz, 2H), 4.60 (s, 2H), 5.06 (s, 2H), 5.22 (d, J=1.8 Hz, 1H), 7.25-7.38 (m, 5H), 8.01 (s, 1H); $^{13}$C NMR (100 MHz, METHANOL-d$_4$) delta ppm 22.7, 27.0, 27.4, 28.5, 34.4, 40.5, 41.4, 51.6, 56.7, 62.4, 64.9, 67.5, 70.0, 70.5, 70.8, 71.1, 71.5, 71.6, 71.65, 71.7, 71.73, 72.6, 73.8, 76.2, 76.5, 82.1, 102.4, 112.4, 126.1, 129.0, 129.1, 129.6, 138.6, 146.1, 159.0, 173.6, 175.7; HRMS (ESI) calcd for $C_{37}H_{56}N_6O_{13}$ (m/z) [M+H]$^+$ 793.3978, found 793.3959.

Intermediate (I-h-2)

THPTA (22 mg, 0.051 mmol) and copper sulfate (2.5 mg, 0.01 mmol) were dissolved in water (70 microL) and then added to a solution of (I-e-2) (48 mg, 0.1 mmol) and alkyne (I-g-2) (20 mg, 0.051 mmol) in methanol (1 mL). Then sodium ascorbate (4 mg, 0.02 mmol), dissolved in water (30 microL), was added and the reaction mixture was stirred at

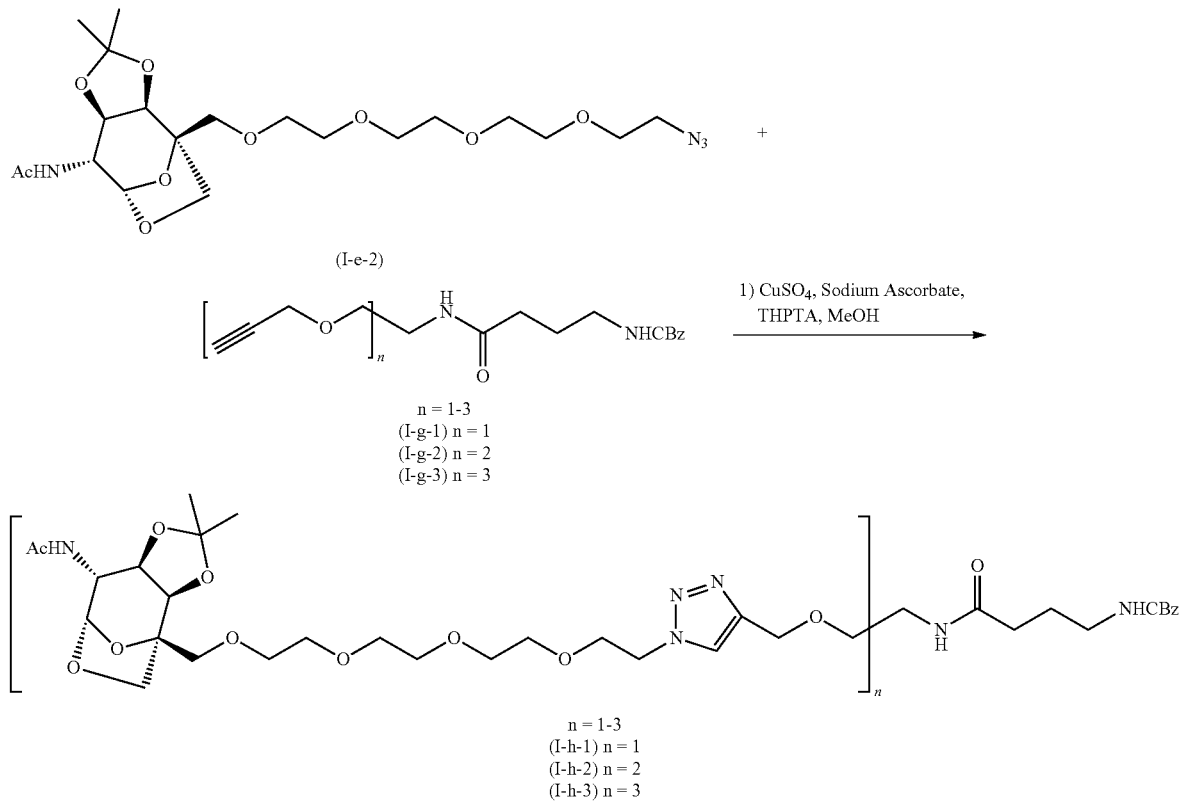

Intermediate (I-h-1):

tris(3-hydroxypropyltriazolylmethyl)amine (THPTA; see M. G. Finn et al. in *Angewandte Chemie International Edition* 48, 9879 (2009)) (2 mg, 0.005 mmol) and copper sulfate (1 mg, 0.004 mmol) were dissolved in water (50 microL) and then added to a solution of (I-e-2) (42 mg, 0.089 mmol) and alkyne (I-g-1) (40 mg, 0.125 mmol) in methanol (0.9 mL). Then sodium ascorbate (1.8 mg, 0.009 mmol), dissolved in water (30 microL), was added and the reaction mixture was stirred at room temperature for 24 hours. Solvent was evaporated and the crude material was purified by flash chromatography (5%-10% methanol in dichloromethane) over silica gel room temperature for 72 hours. Solvent was evaporated and the residue was taken up in dichloromethane and a saturated aqueous solution of ammonium chloride. The aqueous phase was extracted three times with dichloromethane. The combined organic layers were dried over magnesium sulfate, filtered and concentrated. The crude material was used in the next step without any further purification.

Intermediate (I-h-3)

THPTA (34 mg, 0.079 mmol) and copper sulfate (4 mg, 0.016 mmol) were dissolved in water (200 microL) and then added to a solution of (I-e-2) (50 mg, 0.1 mmol) and alkyne (I-g-3) (24 mg, 0.053 mmol) in methanol (1 mL). Then sodium ascorbate (6.5 mg, 0.032 mmol), dissolved in water (30 microL), was added and the reaction mixture was stirred at room temperature for 72 hours. Solvent was evaporated and the residue was taken up in dichloromethane and a saturated aqueous solution of ammonium chloride. The aqueous phase was extracted three times with dichloromethane. The combined organic layers were dried over magnesium sulfate, filtered and concentrated. The crude material was used in the next step without any further purification.

General Procedure for Acetonide Removal:

Compound (I-h-1), (I-h-2), or (I-h-3) (0.030-0.068 mmol) was dissolved in a mixture of acetic acid, methanol and water (1.6-1.8 mL, 0.5 mL, 0.5 mL respectively) and stirred at 70° C. for 24 hours. Solvent was evaporated and the residue was co-evaporated twice with toluene. The crude material was purified by flash chromatography over silica gel.

Example (4)

Purification conditions: 10% methanol in dichloromethane, 43.3 mg, oil (85% yield). $[\alpha]_D$ 45 (c 1, methanol); $^1$H NMR (400 MHz, METHANOL-$d_4$) delta ppm 1.72-1.83 (m, 2H), 1.99 (s, 3H), 2.22 (t, J=7.4 Hz, 2H), 3.13 (t, J=6.8 Hz, 2H), 3.37 (t, J=5.4 Hz, 2H), 3.52-3.79 (m, 20H), 3.85-4.00 (m, 3H), 4.57 (t, J=5.0 Hz, 2H), 4.61 (s, 2H), 5.07 (s, 2H), 5.21 (s, 1H), 7.24-7.41 (m, 5H), 8.02 (s, 1H); $^{13}$C NMR (100 MHz, METHANOL-$d_4$) delta ppm 22.8, 27.4, 34.4, 40.4, 41.4, 51.6, 56.4, 64.9, 67.5, 69.0, 70.0, 70.1, 70.4, 70.5, 71.4, 71.5 (2C), 71.6, 71.65, 71.7, 72.5, 84.3, 102.6, 126.0, 129.0 (2C), 129.1, 129.6 (2C), 138.6, 145.8, 159.0, 174.0, 175.8; HRMS (ESI) calcd for $C_{34}H_{52}N_6O_{13}$ (m/z) $[M+H]^+$ 753.3665, found 753.3679.

Example (5)

Purification conditions: 20% methanol in dichloromethane, 25 mg, oil (20% yield over 2 steps). $[\alpha]_D$ 56 (c 1.25, methanol); $^1$H NMR (400 MHz, METHANOL-$d_4$) delta ppm 1.72-1.81 (m, 2H), 1.99 (s, 6H), 2.23 (t, J=7.5 Hz, 2H), 3.13 (t, J=6.9 Hz, 2H), 3.50-3.80 (m, 36H), 3.85-3.91 (m, 6H), 3.92-4.00 (m, 4H), 4.13-4.25 (m, 1H), 4.52-4.63 (m, 8H), 5.07 (s, 2H), 5.21 (d, J=1.3 Hz, 2H), 7.23-7.40 (m, 5H), 8.01 (s, 2H); $^{13}$C NMR (100 MHz, METHANOL-$d_4$) delta ppm 22.6 (2C), 27.2, 34.2, 41.2, 50.2, 51.4 (2C), 56.2 (2C), 65.0 (2C), 67.3, 68.8 (2C), 69.9 (2C), 70.0 (2C), 70.2 (2C), 70.3 (2C), 71.2 (2C), 71.3 (40), 71.4 (2C), 71.5 (2C), 71.52 (2C), 72.3 (2C), 84.1 (2C), 102.4 (2C), 125.8 (2C), 128.8 (2C), 128.9, 129.4 (2C), 138.4, 145.6 (2C), 158.8, 173.8 (2C), 175.3; HRMS (ESI) calcd for $C_{55}H_{86}N_{10}O_{23}$ (m/z) $[M+H]^+$ 1255.5940, found 1255.5925.

Example (6)

Purification conditions: 20% methanol in dichloromethane, 31 mg, oil (18% yield over 2 steps). $[\alpha]_D$ 53 (c 1, methanol); $^1$H NMR (400 MHz, METHANOL-$d_4$) delta ppm 1.65-1.78 (m, 2H), 1.98 (s, 9H), 2.19 (t, J=7.3 Hz, 2H), 3.11 (t, J=6.8 Hz, 2H), 3.51-3.80 (m, 54H), 3.86-3.91 (m, 9H), 3.91-3.99 (m, 6H), 4.51-4.63 (m, 12H), 5.06 (s, 2H), 5.21 (d, J=1.3 Hz, 3H), 7.24-7.40 (m, 5H), 7.98 (s, 3H); HRMS (ESI) calcd for $C_{76}H_{120}N_{14}O_{33}$ (m/z) $[M+2H]^+/2$ 879.4144. found 879.4148.

N-(2-((1-(1-(((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)ethyl)-4-aminobutanamide (7), 4-amino-N-{1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]propan-2-yl}butanamide (8), 4-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)butanamide (9)

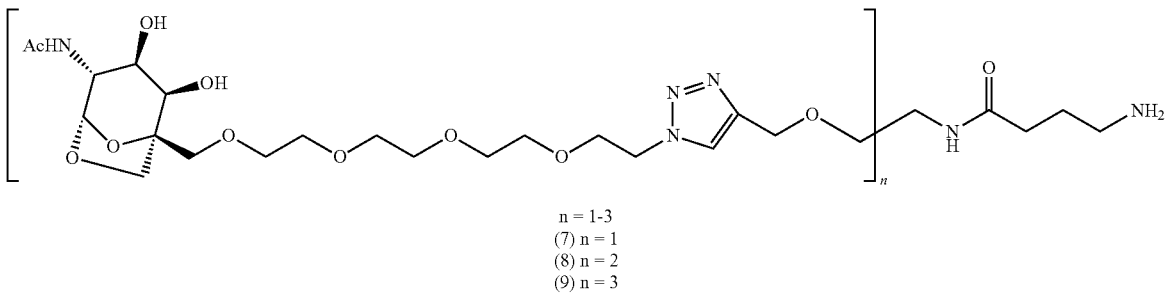

n = 1-3
(7) n = 1
(8) n = 2
(9) n = 3

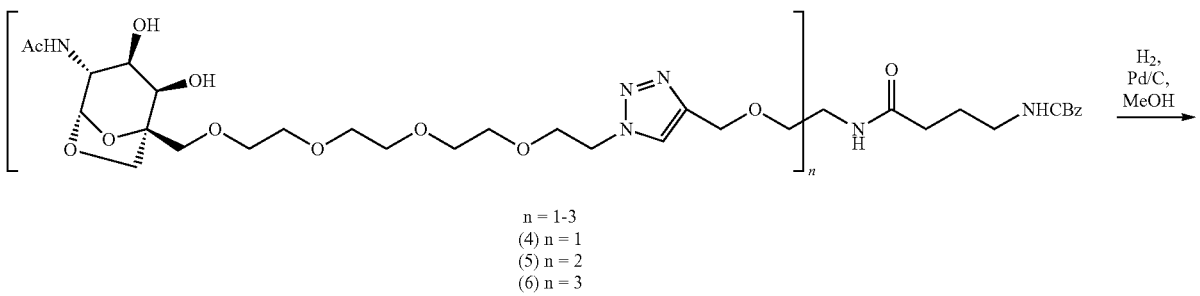

n = 1-3
(4) n = 1
(5) n = 2
(6) n = 3

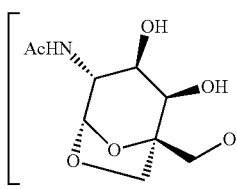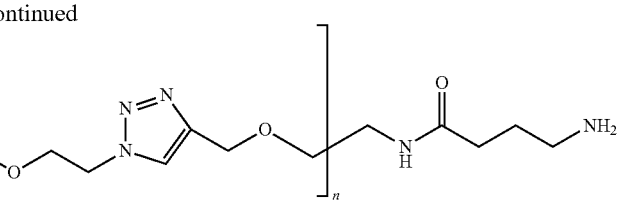

(7) n = 1
(8) n = 2
(9) n = 3

In a round bottom flask, compound (4), (5), or (6) (1 equiv.) was dissolved in methanol (0.01 M) and the flask was flushed with nitrogen. Palladium on carbon (10%, 0.7 equiv.) was added and the flask was flushed with nitrogen and then with hydrogen. The reaction mixture was stirred at room temperature for 12-24 hours under an atmosphere of hydrogen (a balloon filled with hydrogen was used). The palladium was filtered using a 0.45 microm PTFE Acrodisc Cr and rinsed once with methanol. Solvent was evaporated.

Example (7)

25.5 mg, oil, 76% yield; $[\alpha]_D$ 57.6 (c 1.25, methanol); $^1$H NMR (400 MHz, METHANOL-$d_4$) delta ppm 1.70-1.81 (m, 2H), 1.99 (s, 3H), 2.24 (t, J=7.4 Hz, 2H), 2.67 (t, J=6.8 Hz, 2H), 3.36-3.41 (m, 2H), 3.51-3.80 (m, 19H), 3.84-4.01 (m, 4H), 4.59 (t, J=5.2 Hz, 2H), 4.61 (s, 2H), 5.21 (s, 1H), 8.03 (s, 1H); $^{13}$C NMR (100 MHz, METHANOL-$d_4$) delta ppm 22.8, 29.6, 34.5, 40.4, 42.0, 51.6, 56.4, 64.9, 69.0, 70.0, 70.1, 70.5, 70.6, 71.4, 71.5 (2C), 71.6, 71.66, 71.7, 72.5, 84.3, 102.6, 126.0, 145.8, 174.1, 175.9; HRMS (ESI) calcd for $C_{26}H_{46}N_6O_{11}$ (m/z) [M+H]$^+$ 619.3297, found 619.3278.

Example (8)

The crude material was dissolved in 0.5 mL methanol/water (50:50) and injected on a HPLC column. Preparative high-performance liquid chromatography (HPLC) was performed using a Waters XBridge BEH O18 OBD Prep Column, 130 Å, 5 microm, 19 mm×100 mm (Waters, part number 186002978), eluting with a linear slope gradient at 17 mL/min flow rate. Solvent gradient: acetonitrile/water/trifluoroacetic acid (2:98:0.1) to (22:58:0.1) in 40 min. Collected fractions were analyzed by analytical LCMS, and the fractions at 25.7-27.3 minutes judged as having adequate purity were pooled and evaporated to afford 10.7 mg of (8) as an oil, 49% yield; $[\alpha]_D$ 56 (c 1, methanol); $^1$H NMR (500 MHz, METHANOL-$d_4$) delta ppm 1.86-1.95 (m, 2H), 1.99 (s, 6H), 2.37 (t, J=7.0 Hz, 2H), 2.96 (t, J=7.4 Hz, 2H), 3.50-3.80 (m, 36H), 3.84-4.00 (m, 10H), 4.17-4.26 (m, 1H), 4.57-4.62 (m, 8H), 5.21 (s, 2H), 8.03 (s, 2 H); $^{13}$C NMR (100 MHz, METHANOL-$d_4$) delta ppm 22.8 (2C), 29.2, 34.5, 41.8, 50.4, 51.6 (2C), 56.4 (2C), 65.1 (2C), 69.0 (2C), 70.1 (2C), 70.3 (2C), 70.5 (2C), 70.6 (2C), 71.4 (2C), 71.5 (4C), 71.6 (2C), 7.67, (2C), 71.7 (2C), 72.5 (2C), 84.3 (2C), 102.6 (2C), 126.1 (2C), 145.8 (2C), 174.1 (2C), 175.6; HRMS (ESI) calcd for $C_{47}H_{80}N_{10}O_{21}$ (m/z) [M+H]$^+$ 1121.5572, found 1121.5558.

Example (9)

The crude material was dissolved in 0.5 mL methanol/water (50:50), and injected on HPLC column. Preparative high-performance liquid chromatography (HPLC) was performed using a Waters XBridge BEH C18 OBD Prep Column, 130 Å, 5 microm, 19 mm×100 mm (Waters, part number 186002978), eluting with a linear slope gradient at 17 mL/min flow rate. Solvent gradient: acetonitrile/water/trifluoroacetic acid (2:98:0.1) to (22:58:0.1) in 40 min. Collected fractions were analyzed by analytical LCMS, and the fractions at 30.3-32.0 minutes judged as having adequate purity were pooled and evaporated to afford 15 mg of (9) as an oil, 63% yield; $[\alpha]_D$ 59.1 (c 1.1, methanol); $^1$H NMR (500 MHz, METHANOL-$d_4$) delta ppm 1.84-1.92 (m, 2H), 2.00 (s, 9H), 2.31-2.38 (m, 2H), 2.97 (t, J=7.3 Hz, 2H), 3.54-3.80 (m, 54H), 3.86-3.93 (m, 9H), 3.93-4.00 (m, 6H), 4.57 (s, 6H), 4.60 (t, J=4.9 Hz, 6H), 5.22 (s, 3H), 8.02 (s, 3H); HRMS (ESI) calcd for $C_{68}H_{114}N_{14}O_{31}$ (m/z) [M+H]$^+$ 1623.7847, found 1623.7803.

Examples (10), (11), and (12)

Alexa Fluor® 647 Conjugates

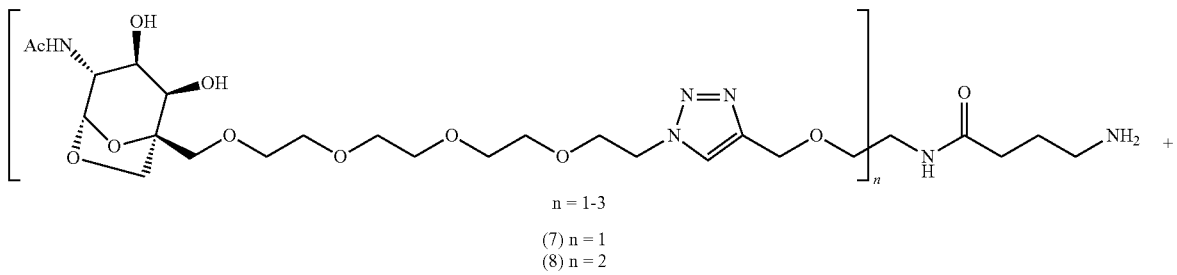

n = 1-3

(7) n = 1
(8) n = 2
(9) n = 3

Alexafluor647-Osu ⟶

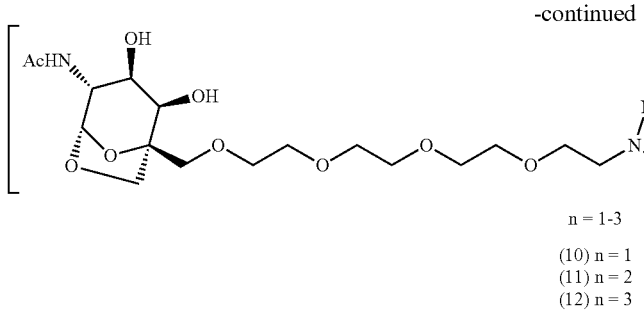

n = 1-3
(10) n = 1
(11) n = 2
(12) n = 3

Alexa Fluor® 647 carboxylic acid succinimidyl ester was from Invitrogen (Catalog NumberA-20106). The molecular weight was reported by Invitrogen to be ~1250. The Alexa647 labeled compound molecular weight was estimated based on the found [M+H]$^+$ of 955.07 of Alexa Fluor 647 carboxylic acid succinimidyl ester from LCMS. Extinction coefficient for $\lambda_{max}$ 650 is ~270000±20000, which varies from batch to batch.

General Procedure for HPLC Purification:

Preparative high-performance liquid chromatography (HPLC) was performed using a Waters XBridge BEH C18 OBD Prep Column, 130 Å, 5 microm, 19 mm×100 mm (Waters, part number 186002978), eluting with a linear slope gradient at 17 mL/min flow rate. Solvent gradient: acetonitrile/water/trifluoroacetic acid (2:98:0.1) to (22:78:0.1) in 40 min. Collected fractions were analyzed by analytical LCMS, and those judged as having adequate purity were pooled and evaporated.

Example (10)

To a solution of compound (7) (3.0 mg, 4.8 micromol) in dimethyl sulfoxide (200 microL) were added Alexa Fluor® 647 carboxylic acid succinimidyl ester (5.0 mg, 4 micromol) and N,N-diisopropylethylamine (10 microL, 10 equiv.). The reaction mixture was shaken at room temperature for 1 hour and then directly purified by preparative HPLC. Collected fractions were analyzed by analytical LCMS, and those judged as having adequate purity were pooled ($R_t$=22.7-24 minutes). 3.2 mg of (10) was obtained (55% yield). The solution was aliquoted and evaporated in a vacuum centrifuge, and the product was stored at 4° C. MS (ESI) calcd (m/z) for [M+H]$^+$ ~1456, found 1456.82.

Example (11)

To a solution of compound (8) (6.0 mg, 5 micromol) in dimethyl sulfoxide (200 microL) were added Alexa Fluor® 647 carboxylic acid succinimidyl ester (5.0 mg, 4 micromol) and N,N-diisopropylethylamine (10 microL, 10 equiv.). The reaction mixture was shaken at room temperature for 1 hour and then directly purified by preparative HPLC. Collected fractions were analyzed by analytical LCMS, and those judged as having adequate purity were pooled ($R_t$=25.3-26.7 minutes). 4.8 mg of (11) was obtained (62% yield). The solution was aliquoted and evaporated in a vacuum centrifuge, and the product was stored at 4° C. MS (ESI) calcd (m/z) for [M+H]$^+$ ~1958, found 1958.74.

Example (12)

To a solution of compound (9) (9.8 mg, 6 micromol) in dimethyl sulfoxide (200 microL) were added Alexa Fluor® 647 carboxylic acid succinimidyl ester (5.0 mg, 4.8 micromol) and N,N-diisopropylethylamine (10 microL, 10 equiv.). The reaction mixture was shaken at room temperature for 1 hour and then directly purified by preparative HPLC. Collected fractions were analyzed by analytical LCMS, and those judged as having adequate purity were pooled ($R_t$=27.7 minutes). 5.2 mg of (12) was obtained (52% yield). The solution was aliquoted and evaporated in a vacuum centrifuge, and the product was stored at 4° C. MS (ESI) calcd (m/z) for [M+H]$^+$ ~2460, found 2461.18.

4-amino-N-[1,31-bis(1-{[(1S,2R,3R,4R,5S)-4-(acetylamino)-2,3-dihydroxy-6,8-dioxabicyclo[3.2.1]oct-1-yl]methyl}-1H-1,2,3-triazol-4-yl)-2,6,10,14,18,22,26,30-octaoxahentriacontan-16-yl]butanamide (13) and 4-amino-N-{1,31-bis(1-{[(1S,2R,3R,4R,5S)-4-(acetylamino)-2,3-dihydroxy-6,8-dioxabicyclo[3.2.1]oct-1-yl]methyl}-1H-1,2,3-triazol-4-yl)-16-[15-(1-{[(1S,2R,3R,4R,5S)-4-(acetylamino)-2,3-dihydroxy-6,8-dioxabicyclo[3.2.1]oct-1-yl]methyl}-1H-1,2,3-triazol-4-yl)-2,6,10,14-tetraoxapentadec-1-yl]-2,6,10,14,18,22,26,30-octaoxahentriacontan-16-yl}butanamide (14)

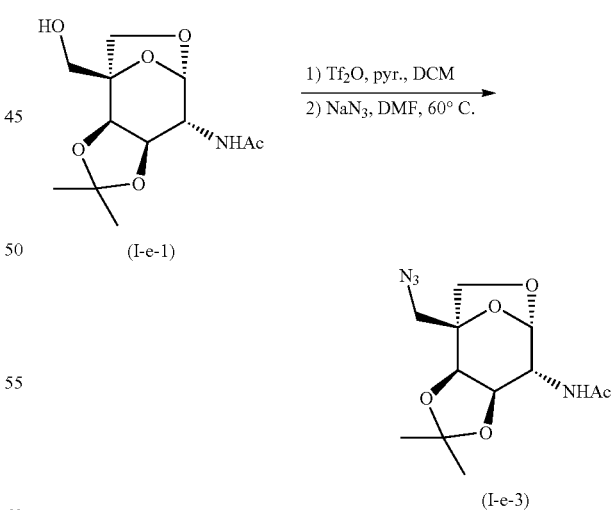

Compound (I-e-1) (247 mg, 0.904 mmol) was dissolved in dichloromethane (15 mL) and pyridine was added (1.46 mL, 18.1 mmol). The reaction mixture was cooled at −20° C. and trifluoromethanesulfonic anhydride (0.23 mL, 1.4 mmol) in dichloromethane (0.6 mL) was added dropwise and the mixture was stirred while allowing warming to 0 degrees C. over 50 minutes. The reaction mixture was diluted with dichloromethane and washed with an aqueous solution of 1M hydrogen chloride, a saturated aqueous solution of sodium bicarbonate and a saturated aqueous solution of sodium chloride. The organic phase was dried over magnesium sulfate, filtered and concentrated. The crude material was used in the next step without any further purification. Sodium azide (270 mg, 4.1 mmol) was added to a solution of the above triflate in dimethylformamide (4.1 mL). The reaction mixture was stirred at 60° C. for 16 hours. Solvent was evaporated and the crude material was purified by flash chromatography (15/1 ethyl acetate/methanol) over silica gel to afford the desired compound (I-e-3) as a yellow oil (227 mg, 92% yield). $[\alpha]_D$ 127 (c 1, methanol); $^1$H NMR (500 MHz, CHLOROFORM-d) delta ppm 1.34 (s, 3H), 1.53 (s, 3H), 2.00 (s, 3H), 3.67 (d, J=12.7 Hz, 1H), 3.72 (d, J=7.8 Hz, 1H), 3.74 (d, J=7.8 Hz, 1H), 3.75 (d, J=12.7 Hz, 1H), 4.02-4.10 (m, 2H), 4.11 (d, J=5.9 Hz, 1H), 5.35 (d, J=2.4 Hz, 1H), 5.95 (d, J=8.8 Hz, 1H); $^{13}$C NMR (125 MHz, CHLOROFORM-d) delta ppm 23.2, 26.2, 27.7, 51.0, 54.2, 69.3, 74.8, 76.1, 80.6, 101.2, 111.6, 170.1; HRMS (ESI) calcd for $C_{12}H_{18}N_4O_5$ (m/z) $[M+H]^+$ 299.1350, found 299.1344.

Compound (I-j-2): Purification conditions: 20% ethyl acetate/hexanes, 85 mg, oil (8% yield); $^1$H NMR (400 MHz, CHLOROFORM-d/TMS) delta ppm 1.77-1.90 (m, 14 H), 2.23 (t, J=7.1 Hz, 2H), 2.43 (t, J=2.3 Hz, 2H), 3.20-3.29 (m, 2H), 3.39-3.55 (m, 24H), 3.60 (t, J=6.3 Hz, 4H), 4.13 (d, J=2.5 Hz, 4H), 4.15-4.24 (m, 1H), 5.09 (s, 2H), 5.16 (br. s., 1H), 6.05 (d, J=8.1 Hz, 1H), 7.28-7.41 (m, 5H); $^{13}$C NMR (100 MHz, CHLOROFORM-d/TMS) delta ppm 25.8, 29.8 (2C), 29.9 (2C), 30.0 (2C), 33.7, 40.4, 48.5, 58.1 (2C), 66.6, 67.2 (2C), 67.6 (2C), 67.7 (2C), 67.8 (2C), 67.9 (2C), 68.3 (2C), 69.0 (2C), 74.2 (2C), 79.9 (2C), 128.1, 128.5 (4C), 136.6, 156.6, 172.1; HRMS (ESI) calcd for $C_{39}H_{62}N_2O_{11}$ (m/z) $[M+H]^+$ 735.4426, found 735.4424.

Compound (I-j-3): Purification conditions: 85% ethyl acetate/hexanes, 32.6 mg, oil, (71% yield); $^1$H NMR (400 MHz, CHLOROFORM-d/TMS) delta ppm 1.75-1.90 (m, 20H), 2.18 (t, J=6.9 Hz, 2H), 2.43 (t, J=2.4 Hz, 3H), 3.23 (q, J=6.3 Hz, 2H), 3.40-3.53 (m, 30H), 3.59 (t, J=6.3 Hz, 6H), 3.67 (s, 6H), 4.13 (d, J=2.3 Hz, 6H), 5.08 (s, 2H), 5.27 (br. s., 1H), 5.85 (s, 1H), 7.27-7.40 (m, 5H); $^{13}$C NMR (100 MHz, CHLOROFORM-d/TMS) delta ppm 25.7, 29.7 (3C), 29.9 (3C), 30.0 (3C), 34.4, 40.4, 58.1 (3C), 59.8, 66.5, 67.1 (3C), 67.6 (3C), 67.7 (3C), 67.8 (3C), 67.82 (3C), 68.4 (3C), 69.1 (3C), 74.2 (3C), 79.9 (3C), 128.0, 128.4 (4C), 136.6, 156.6, 172.3; HRMS (ESI) calcd for $C_{52}H_{84}N_2O_{15}$ (m/z) $[M+H]^+$ 977.5944, found 977.5943.

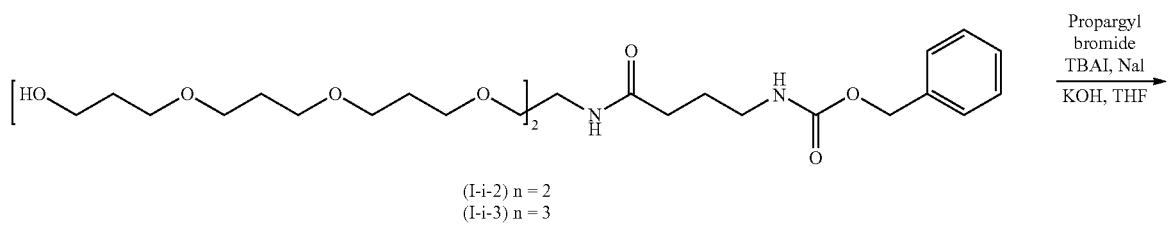

(I-i-2) n = 2
(I-i-3) n = 3

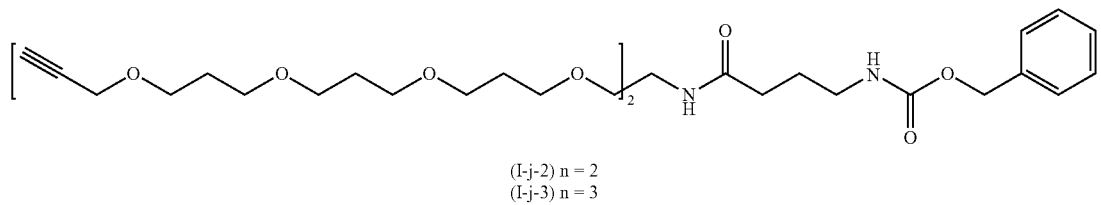

(I-j-2) n = 2
(I-j-3) n = 3

Compound (I-j-2) and (I-j-3) could be made starting from propargyl bromide, (I-i-2) (commercially available from Dalton Pharma; DC-001760) and (I-i-3) (B. Ernst et al. in *Bioorganic & Medicinal Chemistry*, 16, 5216 (2008)) respectively, following the same procedure described for the formation of compound (I-f-2).

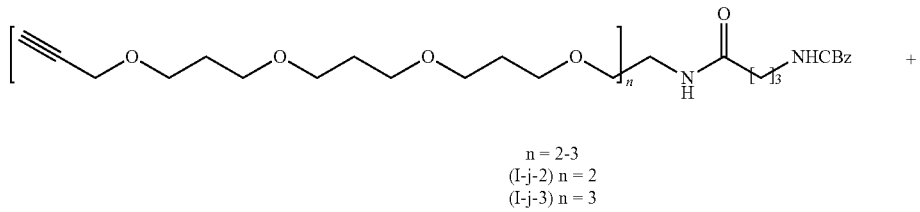

n = 2-3
(I-j-2) n = 2
(I-j-3) n = 3

-continued

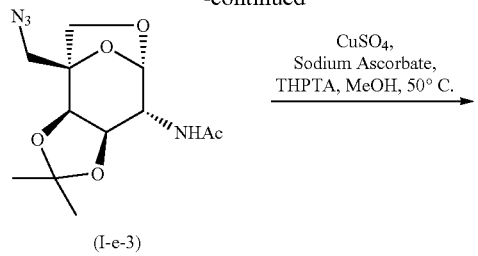

(I-e-3)

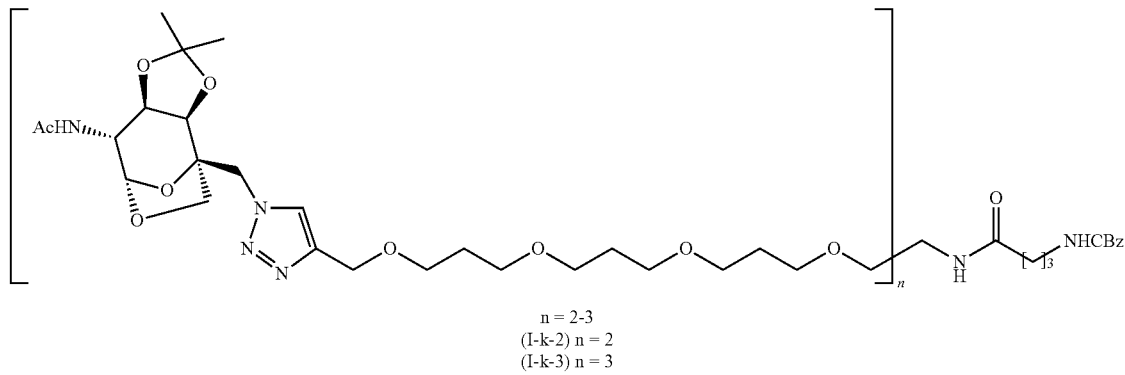

n = 2-3
(I-k-2) n = 2
(I-k-3) n = 3

Compound (I-k-2)

THPTA (22.6 mg, 0.052 mmol) and copper sulfate (2.5 mg, 0.01 mmol) were dissolved in water (200 microL) and then added to a solution of (I-e-3) (45 mg, 0.152 mmol) and (I-j-2) (51 mg, 0.069 mmol) in methanol (1.1 mL). Then sodium ascorbate (4.2 mg, 0.021 mmol), dissolved in water (100 microL), was added and the reaction mixture was stirred at 50 degrees Celsius for 24 hours. Solvent was evaporated and the crude material was purified by flash chromatography (5% methanol in dichloromethane) over silica gel to afford the desired compound (I-k-2) as an oil (72 mg, 78% yield). $^1$H NMR (400 MHz, METHANOL-$d_4$) delta ppm 1.34 (s, 6H), 1.52 (s, 6H), 1.73-1.86 (m, 12H), 1.97 (s, 6H), 2.24 (t, J=7.4 Hz, 2H), 3.15 (t, J=6.8 Hz, 2H), 3.43-3.54 (m, 22H), 3.58 (t, J=6.3 Hz, 4H), 3.86 (d, J=8.1 Hz, 2H), 3.97 (dd, J=6.2, 1.9 Hz, 2H), 4.11-4.23 (m, 5H), 4.58 (s, 4H), 4.78 (s, 6H), 4.91 (d, J=14.1 Hz, 2H), 4.98 (d, J=14.4 Hz, 2H), 5.07 (s, 2H), 5.24 (d, J=1.8 Hz, 2H), 7.25-7.40 (m, 5H), 7.99 (s, 2H); $^{13}$C NMR (100 MHz, METHANOL-$d_4$) delta ppm 22.7 (2C), 26.8 (2C), 27.5, 28.4 (2C), 31.1 (4C), 31.2 (2C), 34.5, 41.4, 50.6, 51.0 (2C), 56.3 (2C), 64.8 (2C), 67.5 (2C), 68.7 (2C), 68.8 (2C), 68.9 (3C), 69.0 (2C), 69.4 (2C), 69.7 (2C), 70.9 (2C), 76.3 (2C), 76.6 (2C), 81.5 (2C), 102.5 (2C), 112.8 (2C), 127.2 (2C), 129.0 (2C), 129.1, 129.6 (2C), 138.6, 146.3 (2C), 159.0, 173.5 (2C), 175.5; HRMS (ESI) calcd for $C_{63}H_{98}N_{10}O_{21}$ (m/z) [M+H]$^+$ 1331.6981, found 1331.6971.

Compound (I-k-3)

THPTA (16 mg, 0.037 mmol) and copper sulfate (1.7 mg, 0.007 mmol) were dissolved in water (100 microL) and then added to a solution of (I-e-3) (32.5 mg, 0.109 mmol) and (I-j-3) (32 mg, 0.033 mmol) in methanol (1.1 mL). Then sodium ascorbate (3 mg, 0.015 mmol), dissolved in water (100 microL), was added and the reaction mixture was stirred at 50 degrees Celsius for 24 hours. Solvent was evaporated and the crude material was purified by flash chromatography (10% methanol in dichloromethane) over silica gel to afford the desired compound (I-k-3) as an oil (43.5 mg, 70% yield). $^1$H NMR (400 MHz, METHANOL-$d_4$) delta ppm 1.33 (s, 9H), 1.52 (s, 9H), 1.71-1.87 (m, 18H), 1.97 (s, 9H), 2.20 (t, J=7.3 Hz, 2H), 3.15 (t, J=6.8 Hz, 2H), 3.43-3.52 (m, 28H), 3.58 (t, J=6.3 Hz, 6H), 3.67 (s, 6H), 3.86 (d, J=8.3 Hz, 3H), 3.97 (dd, J=6.0, 1.8 Hz, 3H), 4.14-4.22 (m, 5H), 4.58 (s, 6H), 4.78 (s, 8H), 4.91 (d, J=14.6 Hz, 3H), 4.97 (d, J=14.6 Hz, 3H), 5.07 (s, 2H), 5.24 (d, J=2.0 Hz, 3H), 7.26-7.38 (m, 5H), 7.98 (s, 3H); $^{13}$C NMR (100 MHz, METHANOL-$d_4$) delta ppm 22.7 (3C), 26.9 (3C), 27.7, 28.4 (3C), 31.1 (3C), 31.2 (3C), 31.3 (3C), 35.2, 41.3, 51.0 (3C), 56.3 (3C), 61.8, 64.9 (3C), 67.5 (3C), 68.7 (3C), 68.8 (3C), 68.9 (3C), 69.0 (4C), 69.6 (3C), 69.7 (3C), 70.0 (3C), 76.3 (3C), 76.6 (3C), 81.5 (3C), 102.5 (3C), 112.8 (3C), 127.2 (3C), 129.0 (2C), 129.1, 129.7 (2C), 138.6, 146.4 (3C), 159.0, 173.5 (3C), 175.6; HRMS (ESI) calcd for $C_{88}H_{138}N_{14}O_{30}$ (m/z) [M+H]$^+$ 1871.9776, found 1871.9713.

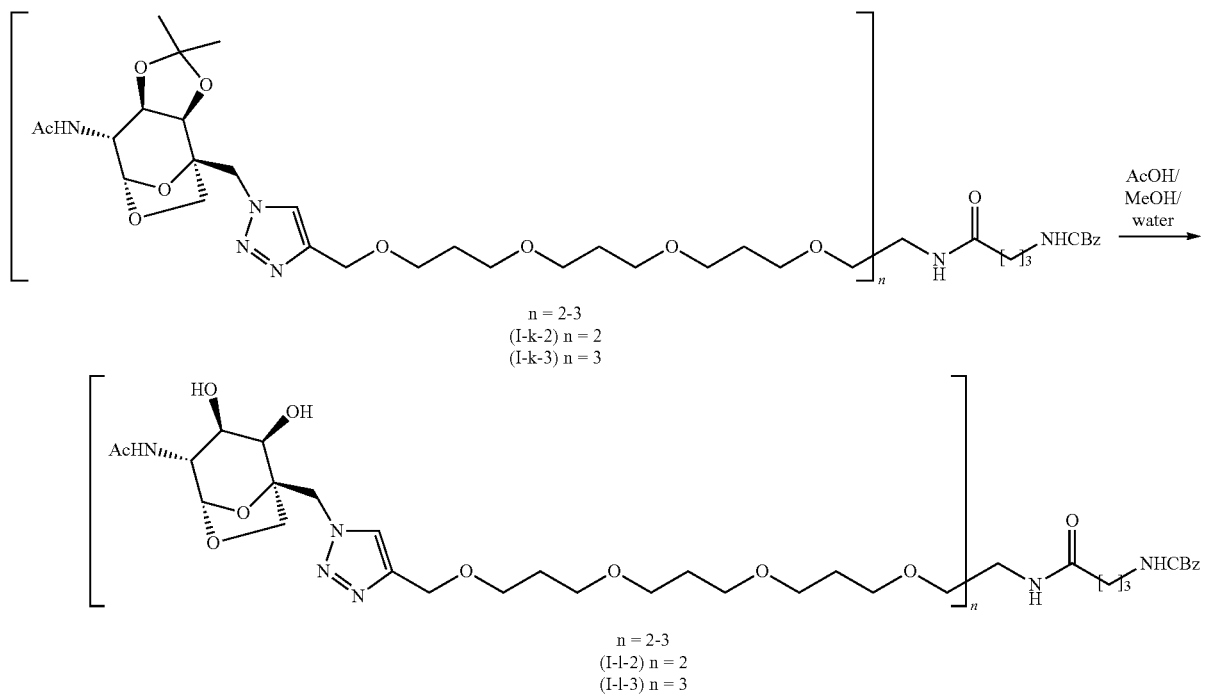

n = 2-3
(I-k-2) n = 2
(I-k-3) n = 3 n = 2-3
(I-l-2) n = 2
(I-l-3) n = 3

Compound (I-k-2) or (I-k-3) (0.068 mmol) was dissolved in a mixture of acetic acid, methanol and water (2.5-3 mL, 0.6-0.9 mL, 0.6-0.9 mL respectively) and stirred at 70 degrees Celsius for 24 hours. Solvent was evaporated and the residue was co-evaporated twice with toluene. The crude material obtained was used in the next step without any further purification.

In a round bottom flask, compound (I-l-2) or (I-l-3) (1 equiv.) was dissolved in methanol (0.01 M) and the flask was flushed with nitrogen. Palladium on carbon (10%, 0.7 equiv.) was added and the flask was flushed with nitrogen and then with hydrogen. The reaction mixture was stirred at room temperature for 24 hours under an atmosphere of hydrogen (a balloon filled with hydrogen was used). The palladium was

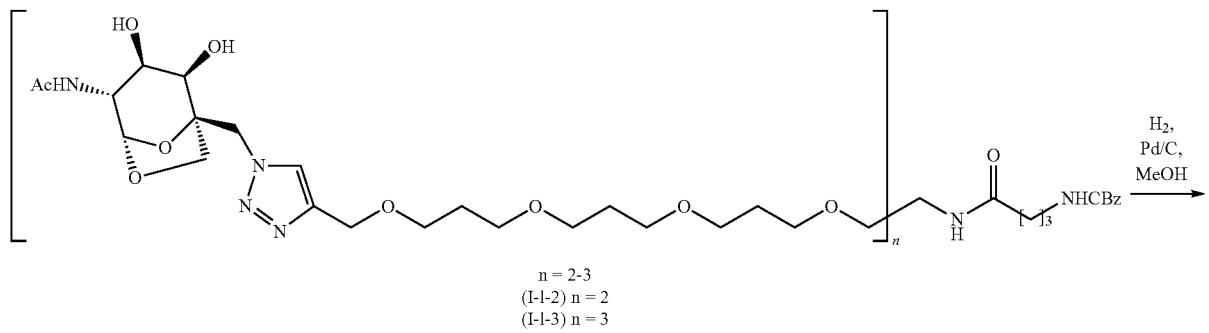

n = 2-3
(I-l-2) n = 2
(I-l-3) n = 3

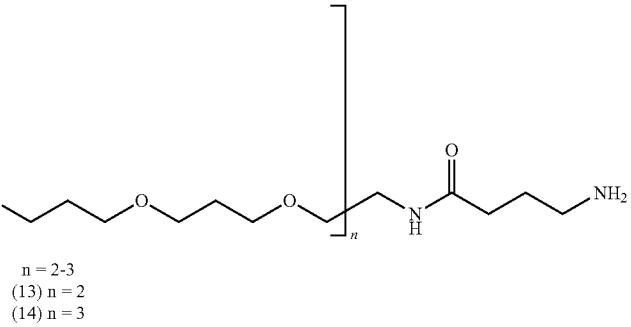

n = 2-3
(13) n = 2
(14) n = 3 filtered using a 0.45 microm PTFE Acrodisc Cr and rinsed once with methanol. Solvent was evaporated.

Example (13)

The crude material was dissolved in 0.5 mL methanol/water (50:50) and injected on a HPLC column. Preparative high-performance liquid chromatography (HPLC) was performed using a Waters XBridge BEH C18 OBD Prep Column, 130 Å, 5 microm, 19 mm×100 mm (Waters, part number 186002978), eluting with a linear slope gradient at 17 mL/min flow rate. Solvent gradient: acetonitrile/water/trifluoroacetic acid (2:98:0.1) to (22:58:0.1) in 40 min. Collected fractions were analyzed by analytical LCMS, and the fractions at 34.7-35.6 minutes judged as having adequate purity were pooled and evaporated to afford 12.8 mg of (13) as an oil, (17% yield over 2 steps); $^1$H NMR (500 MHz, METHANOL-$d_4$) delta ppm 1.73-1.87 (m, 12H), 1.88-1.96 (m, 2H), 1.98 (s, 6H), 2.39 (t, J=7.0 Hz, 2H), 2.98 (t, J=7.4 Hz, 2H), 3.42 (d, J=8.5 Hz, 2H), 3.45-3.55 (m, 24H), 3.59 (t, J=6.3 Hz, 4H), 3.71-3.75 (m, 4H), 3.77 (d, J=8.3 Hz, 2H), 3.96-4.02 (m, 2H), 4.13-4.20 (m, 1H), 4.58 (s, 4H), 4.91-4.95 (m, 4H), 5.20 (d, J=1.5 Hz, 2H), 7.98 (s, 2H); HRMS (ESI) calcd for $C_{49}H_{84}N_{10}O_{19}$ (m/z) [M+H]$^+$ 1117.5987, found 1117.5977.

Example (14)

The crude material was dissolved in 0.5 mL methanol/water (50:50) and injected on a HPLC column. Preparative high-performance liquid chromatography (HPLC) was performed using a Waters XBridge BEH C18 OBD Prep Column, 130 Å, 5 microm, 19 mm×100 mm (Waters, part number 186002978), eluting with a linear slope gradient at 17 mL/min flow rate. Solvent gradient: acetonitrile/water/trifluoroacetic acid (2:98:0.1) to (42:58:0.1) in 40 min. Collected fractions were analyzed by analytical LCMS, and the fractions at 24.7-25.6 minutes judged as having adequate purity were pooled and evaporated to afford 5.5 mg of (14) as an oil (10% yield over 2 steps); $^1$H NMR (500 MHz, METHANOL-$d_4$) delta ppm 1.75-1.86 (m, 18H), 1.87-1.94 (m, 2H), 1.98 (s, 9H), 2.37 (t, J=6.8 Hz, 2H), 2.98 (t, J=7.4 Hz, 2H), 3.43 (d, J=8.5 Hz, 3H), 3.46-3.53 (m, 31H), 3.59 (t, J=6.3 Hz, 6H), 3.68 (s, 6H), 3.72-3.76 (m, 5H), 3.77 (d, J=8.3 Hz, 3H), 3.97-4.02 (m, 3H), 4.59 (s, 6H), 4.90-4.96 (m, 6H), 5.20 (d, J=1.2 Hz, 3H) 7.98 (s, 3H); HRMS (ESI) calcd for $C_{71}H_{120}N_{14}O_{28}$ (m/z) [M+H]$^+$ 1617.8469, found 1617.8415.

Examples (15) and (16)

Alexa Fluor® 647 (AF647) Conjugates

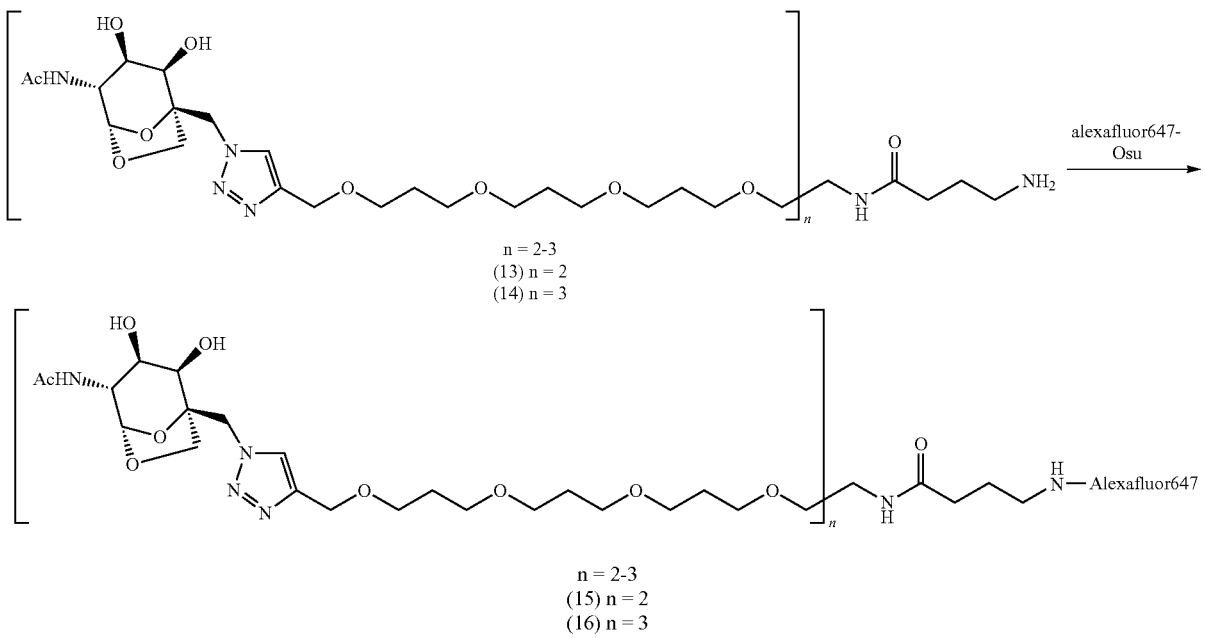

Alexa Fluor® 647 carboxylic acid succinimidyl ester was from Invitrogen (Catalog NumberA-20106). The molecular weight was reported by Invitrogen to be ~1250. The Alexa647 labeled compound molecular weight was estimated based on the found [M+H]$^+$ of 955.07 of Alexa Fluor 647 carboxylic acid succinimidyl ester from LCMS. Extinction coefficient for $\lambda_{max}$ 650 is ~270000±20000, which varies from batch to batch.

General Procedure for HPLC Purification:

Preparative high-performance liquid chromatography (HPLC) was performed using a Waters XBridge BEH C18 OBD Prep Column, 130 Å, 5 microm, 19 mm×100 mm (Waters, part number 186002978), eluting with a linear slope gradient at 17 mL/min flow rate. Solvent gradient: acetonitrile/water/trifluoroacetic acid (2:98:0.1) to (22:78:0.1) in 40 min. Collected fractions were analyzed by analytical LCMS, and those judged as having adequate purity were pooled and evaporated.

Example (15)

To a solution of compound (13) (4.5 mg, 4 micromol) in dimethyl sulfoxide (200 microL) were added Alexa Fluor® 647 carboxylic acid succinimidyl ester (5.0 mg, 4 micromol) and N,N-diisopropylethylamine (10 microL, 10 equiv.). The reaction mixture was shaken at room temperature for 1 hour and then directly purified by preparative HPLC. Collected fractions were analyzed by analytical LCMS, and those judged as having adequate purity were pooled ($R_t$=37.3-39 minutes). 4.0 mg of (15) was obtained (50% yield). The solution was aliquoted and evaporated in a vacuum centrifuge, and the product was stored at 4 degrees Celsius. MS (ESI) calcd (m/z) for $[M+H]^+$ ~1955, found 1955.32.

Example (16)

To a solution of compound (14) (5.2 mg, 3.2 micromol) in dimethyl sulfoxide (200 microL) were added Alexa Fluor® 647 carboxylic acid succinimidyl ester (5.0 mg, 4 micromol) and N,N-diisopropylethylamine (10 microL, 10 equiv.). The reaction mixture was shaken at room temperature for 1 hour and then directly purified by preparative HPLC. Collected fractions were analyzed by analytical LCMS, and those judged as having adequate purity were pooled ($R_t$=24.3-25.3 minutes). 4.0 mg of (16) was obtained (51% yield). The solution was aliquoted and evaporated in a vacuum centrifuge, and the product was stored at 4° C. MS (ESI) calcd (m/z) for $[M+H]^+$ ~2455, found 2456.90.

General Alkylation/Deprotection Conditions to Access Examples (17)-(21):

To a solution of (I-e-1) in dichloromethane was added the desired iodoalkyl, tetrabutylammonium hydrogen sulfate, and 12.5M sodium hydroxide aqueous solution. The reaction mixture was allowed to stir overnight at room temperature, was diluted with water and dichloromethane and the aqueous phase was extracted two additional times with dichloromethane. The combined organic layers were washed with an aqueous solution of 1M hydrochloric acid, water, dried over magnesium sulfate, filtered and concentrated under reduced pressure. The resulting material can be either carried on crude to the next reaction or purified using flash chromatography over silica gel. The resulting material was dissolved in a mixture of acetic acid/methanol/water (3:1:1 v/v) and the solution was heated to 60-70 degrees Celsius overnight. The reaction mixture was concentrated under reduced pressure, co-evaporated two times with toluene and the crude material was purified by flash chromatography over silica gel or reverse phase chromatography.

N-[(1S,2R,3R,4R,5S)-1-(ethoxymethyl)-2,3-dihydroxy-6,8-dioxabicyclo[3.2.1]oct-4-yl]acetamide
(17)

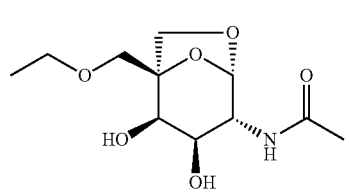

(17)

(17) was synthesized as described in the general procedure above using iodoethane (20 equiv.). The crude product was dissolved in methanol and to which was added activated charcoal. The mixture was stirred for 15 minutes, filtered and concentrated under reduced pressure. The crude material was purified by flash chromatography over silica gel eluting with ethyl acetate/methanol (15:1). The fractions containing the desired product were collected and concentrated under reduced pressure. To the crude material was added ethyl acetate/methanol (15:1) which resulted in a precipitate that was filtered yielding 9.1 mg (32% yield) of the desired product as a solid. $^1$H NMR (400 MHz, METHANOL-$d_4$) delta ppm 5.23 (d, J=1.5 Hz, 1 H), 3.97 (dd, J=9.7, 1.4 Hz, 1 H), 3.94 (d, J=9.3 Hz, 1 H), 3.88 (d, J=4.3 Hz, 1 H), 3.79 (d, J=8.1 Hz, 1 H), 3.73 (dd, J=9.8, 4.3 Hz, 1 H), 3.66 (d, J=8.1 Hz, 1 H), 3.60 (d, J=9.6 Hz, 1 H), 3.59 (dq, J=9.6, 7.1 Hz, 1 H), 3.55 (dq, J=9.6, 7.1 Hz, 1 H), 2.00 (s, 3 H), 1.19 (t, J=6.9 Hz, 3 H). LCMS (APCI) m/z: 262.1 [M+H] (100%).

N-[(1S,2R,3R,4R,5S)-2,3-dihydroxy-1-(propoxymethyl)-6,8-dioxabicyclo[3.2.1]oct-4-yl]acetamide
(18)

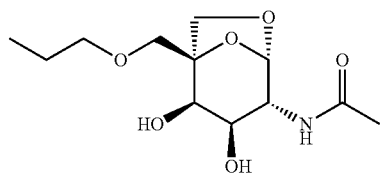

(18)

(18) was synthesized as described in the general procedure above using iodopropane (20 equiv.). The crude product was purified using flash chromatography over silica gel eluting with ethyl acetate/methanol (15:2) yielding 13.9 mg (80% yield) of the desired product as an oil. $^1$H NMR (400 MHz, METHANOL-$d_4$) delta ppm 5.23 (d, J=1.5 Hz, 1 H), 3.97 (dd, J=9.7, 1.4 Hz, 1H), 3.95 (d, J=9.6 Hz, 1 H), 3.89 (d, J=4.3 Hz, 1 H), 3.79 (d, J=7.8 Hz, 1 H), 3.73 (dd, J=9.8, 4.3 Hz, 1 H), 3.66 (d, J=8.1 Hz, 1 H), 3.59 (d, J=9.3 Hz, 1 H), 3.49 (dt, J=9.3, 6.5 Hz, 1 H), 3.46 (dt, J=9.3, 6.5 Hz, 1 H), 2.01 (s, 3 H), 1.60 (qt, J=7.4, 6.5 Hz, 2 H), 0.94 (t, J=7.4 Hz, 3 H). LCMS (APCI) m/z: 276.2 [M+H] (100%).

N-[(1S,2R,3R,4R,5S)-1-(butoxymethyl)-2,3-dihydroxy-6,8-dioxabicyclo[3.2.1]oct-4-yl]acetamide
(19)

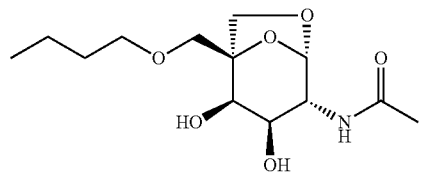

(19)

(19) was synthesized as described in the general procedure above using iodobutane (20 equiv.). The desired crude product was purified using flash chromatography over silica gel eluting with ethyl acetate/methanol (15:1) yielding 18 mg (100% yield) of the desired product as an oil. $^1$H NMR (400 MHz, METHANOL-$d_4$) delta ppm 5.23 (d, J=1.3 Hz, 1 H), 3.97 (dd, J=9.6, 1.3 Hz, 1 H), 3.94 (d, J=9.6 Hz, 1 H), 3.88 (d, J=4.3 Hz, 1 H), 3.79 (d, J=7.8 Hz, 1 H), 3.73 (dd, J=9.8, 4.3 Hz, 1 H), 3.66 (d, J=7.8 Hz, 1 H), 3.59 (d, J=9.3 Hz, 1 H), 3.54 (dt, J=9.3, 6.5 Hz, 1 H), 3.50 (dt, J=9.3, 6.5 Hz, 1 H), 2.00 (s, 3 H), 1.52-1.61 (m, 2 H), 1.34-1.45 (m, 2H), 0.95 (t, J=7.3 Hz, 3 H). LCMS (APCI) m/z: 290.2 [M+H] (100%).

N-{(1S,2R,3R,4R,5S)-2,3-dihydroxy-1-[(pentyloxy)methyl]-6,8-dioxabicyclo[3.2.1]oct-4-yl}acetamide (20)

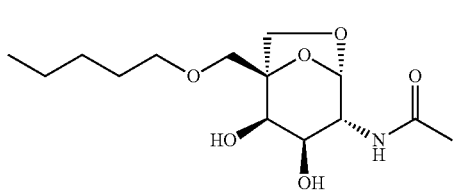

(20) was synthesized as described in the general procedure above using iodopentane (20 equiv.). The desired crude product was purified using flash chromatography over silica gel eluting with ethyl acetate/methanol (15:1) yielding 17 mg (68% yield) of the desired product as an oil. $^1$H NMR (400 MHz, METHANOL-d$_4$) delta ppm 5.23 (d, J=1.5 Hz, 1 H), 3.97 (dd, J=9.8, 1.3 Hz, 1 H), 3.94 (d, J=9.6 Hz, 1 H), 3.88 (d, J=4.3 Hz, 1 H), 3.79 (d, J=8.1 Hz, 1 H), 3.73 (dd, J=9.8, 4.3 Hz, 1 H), 3.66 (d, J=8.1 Hz, 1 H), 3.59 (d, J=9.6 Hz, 1 H), 3.53 (dt, J=9.3, 6.5 Hz, 1H), 3.49 (dt, J=9.3, 6.5 Hz, 1 H), 2.01 (s, 3 H), 1.53-1.63 (m, 2 H), 1.29-1.41 (m, 4 H), 0.89-0.97 (m, 3 H). LCMS (APCI) m/z: 304.1 [M+H] (100%).

N-{(1S,2R,3R,4R,5S)-1-[(hexyloxy)methyl]-2,3-dihydroxy-6,8-dioxabicyclo[3.2.1]oct-4-yl}acetamide (21)

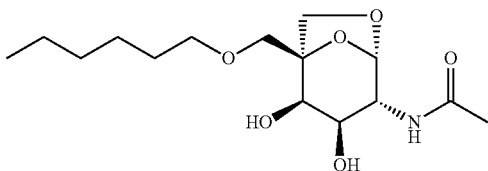

(21) was synthesized as described in the general procedure above using iodohexane (20 equiv.). The desired crude product was purified using flash chromatography over silica gel eluting with ethyl acetate/methanol (15:1) yielding 56 mg of product as an oil. This material was repurified using reverse phase chromatography yielding 7.1 mg (15% yield) of the desired product as a solid. $^1$H NMR (400 MHz, METHANOL-d$_4$) delta ppm 5.23 (d, J=1.5 Hz, 1 H), 3.96 (dd, J=10.1, 1.3 Hz, 1 H), 3.94 (d, J=9.6 Hz, 1 H), 3.88 (d, J=4.3 Hz, 1 H), 3.79 (d, J=7.8 Hz, 1 H), 3.73 (dd, J=9.8, 4.3 Hz, 1 H), 3.66 (d, J=8.1 Hz, 1 H), 3.59 (d, J=9.6 Hz, 1 H), 3.53 (dt, J=9.3, 6.5 Hz, 1 H), 3.49 (dt, J=9.3, 6.5 Hz, 1 H), 2.00 (s, 3 H), 1.53-1.62 (m, 2 H), 1.27-1.50 (m, 6 H), 0.89-0.97 (m, 3 H). LCMS (APCI) m/z: 318.1 [M+H] (100%).

N-[(1S,2R,3R,4R,5S)-2,3-dihydroxy-1-(2,5,8,11,14-pentaoxapentadec-1-yl)-6,8-dioxabicyclo[3.2.1]oct-4-yl]acetamide (22)

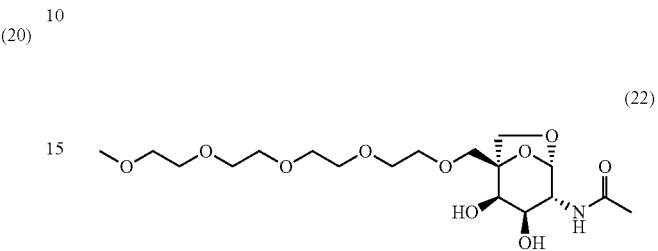

To a solution of (I-e-1) in dichloromethane (3 mL) was added pyridine (0.3 mL, 4 mmol), the mixture was cooled to −20 degrees Celsius, and trifluoromethanesulfonic anhydride (0.047 mL, 0.28 mmol) in dichloromethane (0.6 mL) was added. The reaction mixture was allowed to warm to −10 degrees Celsius over 1 hour, was diluted with dichloromethane and successively washed with an aqueous solution of 1M hydrochloric acid, saturated sodium bicarbonate aqueous solution, brine, dried over magnesium sulfate, filtered, and concentrated under reduced pressure to afford the desired crude material which was used in the next step without further purification. To a solution of 2,5,8,11-tetraoxatridecan-13-ol (207 mg, 0.994 mmol) in N,N-dimethylformamide cooled to 0 degrees Celsius was added sodium hydride (39.9 mg, 1.0 mmol) and the reaction mixture was stirred for 10 minutes. The above crude ((3aR,4R,7S,8R,8aR)-8-acetamido-2,2-dimethyltetrahydro-4,7-epoxy[1,3]dioxolo[4,5-d]oxepin-4(5H)-yl)methyl trifluoromethanesulfonate in N,N-dimethylformamide (0.5 mL) was added dropwise and the reaction mixture was allowed to stir for 25 minutes at 0 degrees Celsius. The reaction was quenched with methanol and the reaction mixture was allowed to stir for 5 minutes. The resulting mixture was then concentrated under reduced pressure and the residue obtained was dissolved in dichloromethane and washed with water. The aqueous layer was extracted two additional times with dichloromethane. The combined organic layers were washed with water and concentrated under reduced pressure. The crude material was purified by flash chromatography over silica gel eluting with ethyl acetate/methanol (15:2) yielding 85 mg (100%) of the desired product. A solution of N-((3aR,4S,7S,8R,8aR)-2,2-dimethyl-4-(2,5,8,11,14-pentaoxapentadecyl)hexahydro-4,7-epoxy[1,3]dioxolo[4,5-d]oxepin-8-yl)acetamide (85 mg, 0.18 mmol) in a mixture of acetic acid/methanol/water (3.9:1.3:1.3 v/v) was heated to 70 degrees Celsius overnight. The reaction mixture was concentrated under reduced pressure, the resulting crude material co-evaporated two times with toluene and purified by flash chromatography over silica gel eluting with 10% methanol/dichloromethane yielding 15 mg of the desired product (22) as an oil. $^1$H NMR (400 MHz, METHANOL-d$_4$) delta ppm 5.22 (d, J=1.3 Hz, 1 H), 3.96 (d, J=9.6 Hz, 1 H), 3.95 (dd, J=9.9, 1.3 Hz, 1 H), 3.89 (d, J=4.3 Hz, 1 H), 3.78 (d, J=8.1 Hz, 1 H), 3.59-3.74 (m, 17H), 3.53-3.56 (m, 2

H), 3.36 (s, 3 H), 1.99 (s, 3 H). LCMS (APCI) m/z: 424.2 [M+H] (13%), 441.3 [M+NH$_4$] (100%).

(1R,2R,3R,4R,5S)-4-acetamido-1-(((4-bromobenzoyl)oxy)methyl)-6,8-dioxabicyclo[3.2.1]octane-2,3-diyl bis(4-bromobenzoate) (23)

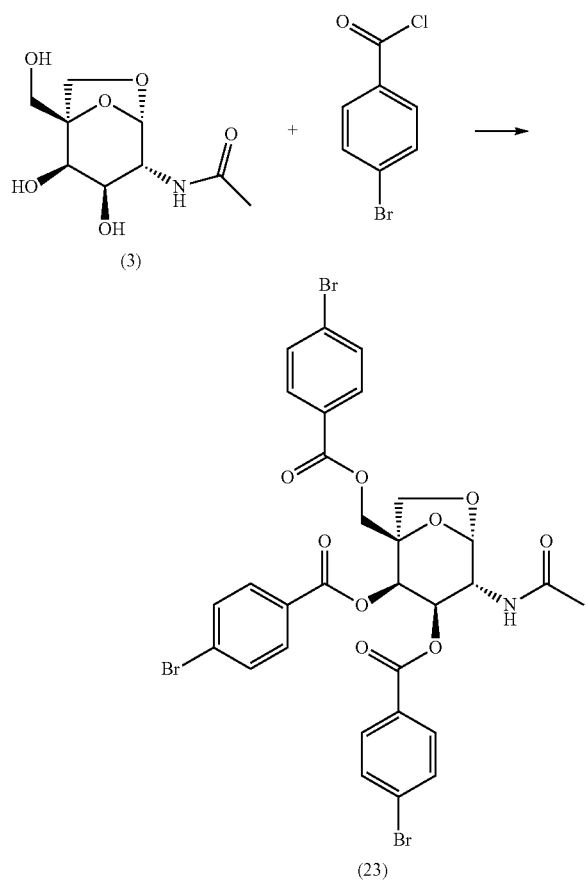

To a solution of (3) (9 mg) in anhydrous N,N-dimethylformamide (500 microL) cooled at room temperature were added N,N-diisopropylethylamine (34 microL) and 4-(dimethylamino)pyridine (4.3 mg) followed by p-bromobenzoyl chloride (44 mg), and the resulting mixture was stirred at room temperature for 4.5 h. Water was added, the resulting mixture extracted three times with ethyl acetate, and the combined organic phase was successively washed with 0.5 M aqueous hydrochloric acid solution and brine. The organic phase was dried over magnesium sulfate, filtered, and concentrated, and the crude material was purified by flash chromatography over silica gel, eluting with a gradient of 0-100% ethyl acetate in heptane, to afford 23 mg of product (23) (80% yield). 1H NMR (400 MHz, CDCl3): delta (ppm) 7.89-7.95 (m, 2 H), 7.78-7.84 (m, 2 H), 7.54-7.66 (m, 6 H), 7.41-7.46 (m, 2 H), 5.87 (d, J=8.8 Hz, 1 H), 5.80 (d, J=4.3 Hz, 1 H), 5.60 (d, J=1.1 Hz, 1 H), 5.44 (dd, J=10.2, 4.5 Hz, 1 H), 4.54-4.64 (m, 3 H), 4.15 (d, J=8.6 Hz, 1 H), 3.93 (d, J=8.6 Hz, 1 H), 1.95 (s, 3 H). $^{13}$C NMR (101 MHz, CDCl3) delta ppm 170.6, 165.6, 165.0, 164.9, 132.1, 131.9, 131.8, 131.4, 131.2, 131.2, 129.3, 129.0, 128.9, 127.7, 127.5, 127.4, 101.8, 81.6, 69.5, 68.8, 68.4, 62.5, 52.7, 23.2. Single crystals were obtained by vapor diffusion technique using methanol and heptane as solvents. Single crystal X-Ray analysis: Data collection was performed on a Bruker APEX diffractometer at room temperature. Data collection consisted of 3 omega scans and low angle and three at high angle; each with 0.5 step. In addition, 2 phi scans were collected to improve the quality of the absorption correction. Structure is a non-merohedral twin; refined by ignoring the second domain. The structure was solved by direct methods using SHELX software suite (see SHELXTL, Version 5.1, Bruker AXS, 1997) in the space group P2(1). The structure was subsequently refined by the full-matrix least squares method. All non-hydrogen atoms were found and refined using anisotropic displacement parameters. The hydrogen atom located on nitrogen was placed in this position and constrained in reasonable position. The remaining hydrogen atoms were placed in calculated positions and were allowed to ride on their carrier atoms. The final refinement included isotropic displacement parameters for all hydrogen atoms. Analysis of the absolute structure using likelihood methods (R. W. W. Hooft et al. *J. Appl. Cryst.*, 41, 96-103 (2008)) was performed using PLATON (A. L. Spek, *J. Appl. Cryst.*, 36, 7-13 (2003)). The results indicate that the absolute structure has been correctly assigned. The method calculates that the probability that the structure is correct is 100.0. The Hooft parameter is reported as 0.036 with an esd of 0.013. Additionally, the Flack parameter is 0.03 with and esd of 0.04. The final R-index was 5.6%. A final difference Fourier revealed no missing or misplaced electron density. Pertinent crystal, data collection and refinement are summarized in table 1 and FIG. 1.

TABLE 1

| Crystal data and structure refinement for (23). | |
|---|---|
| Empirical formula | C15 H12 Br1.50 N0.50 O4.50 |
| Formula weight | 391.12 |
| Temperature | 296(2) K |
| Wavelength | 1.54178 Å |
| Crystal system | Monoclinic |
| Space group | P2(1) |
| Unit cell dimensions | a = 12.5748(9) Å  α = 90°. |
| | b = 5.6465(4) Å  β = 97.453(4)°. |
| | c = 21.2806(16) Å  γ = 90°. |
| Volume | 1498.23(19) Å$^3$ |
| Z | 4 |
| Density (calculated) | 1.734 Mg/m$^3$ |
| Absorption coefficient | 5.476 mm$^{-1}$ |
| F(000) | 776 |
| Crystal size | 0.37 x 0.22 x 0.15 mm$^3$ |
| Theta range for data collection | 2.09 to 68.30°. |
| Index ranges | −13 <= h <= 15, −5 <= k <= 6, −24 <= l <= 24 |
| Reflections collected | 8050 |
| Independent reflections | 4408 [R(int) = 0.0247] |
| Completeness to theta = 68.30° | 93.9% |
| Absorption correction | Empirical |
| Refinement method | Full-matrix least-squares on F$^2$ |
| Data/restraints/parameters | 4408/32/389 |
| Goodness-of-fit on F$^2$ | 1.031 |
| Final R indices [I > 2sigma(I)] | R1 = 0.0563, wR2 = 0.1658 |
| R indices (all data) | R1 = 0.0589, wR2 = 0.1701 |
| Absolute structure parameter | 0.04(3) |
| Largest diff. peak and hole | 0.949 and −0.685 e.Å$^{-3}$ |

(1S,2R,3R,4R,5S)-4-azido-2,3-bis(benzyloxy)-1-[(benzyloxy)methyl]-6,8-dioxabicyclo[3.2.1]octane (I-m-1)

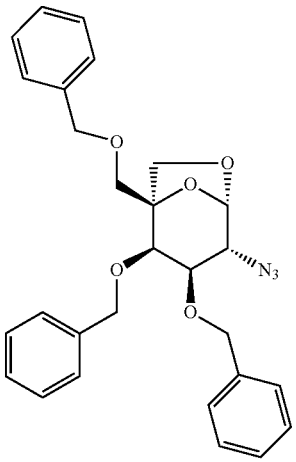 [SMILES: [N-]=[N+]=N[C@H]1[C@H]2OC[C@](COCc3ccccc3)(O2)[C@H](OCc2ccccc2)[C@@H]1OCc1ccccc1]

To a solution of (1S,2R,3R,4R,5S)-4-azido-1-(hydroxymethyl)-6,8-dioxabicyclo[3.2.1]octane-2,3-diol (1) (445 mg, 2.05 mmol) in N,N-dimethylformamide (5 mL) was added sodium hydride (60% dispersion in mineral oil, 410 mg, 10.2 mmol) at room temperature. The reaction became very thick and would not stir well. An additional 5 mL N,N-dimethylformamide was added and the reaction was stirred for 30 minutes at room temperature before the addition of benzylbromide (1.23 mL, 10.2 mmol) drop wise. The reaction was allowed to stir overnight at room temperature. The following morning the reaction was quenched with water and extracted with ethyl acetate three times. The combined organic layer was washed with water, brine, dried over sodium sulfate, filtered and concentrated under reduced pressure. The crude material was purified using the CombiFlash Rf (RediSep 40 g silica gel column) and eluting with a gradient of 0-30% ethyl acetate/heptane yielding the title compound (890.0 mg, 89.1%). Method C: 3 minute run LRMS [M+Na=510]. $^1$H NMR (METHANOL-$d_4$) δ: 7.07-7.52 (m, 15H), 5.31 (s, 1H), 4.81 (d, J=5.1 Hz, 1H), 4.78 (d, J=5.5 Hz, 1H), 4.68-4.74 (m, 1H), 4.47-4.51 (m, 1H), 4.46 (d, J=6.6 Hz, 1H), 4.35-4.42 (m, 1H), 4.12 (d, J=3.9 Hz, 1H), 3.87-3.91 (m, 2H), 3.86 (d, J=8.2 Hz, 1H), 3.62 (d, J=8.2 Hz, 1H), 3.58 (d, J=9.4 Hz, 1H), 3.46 (d, J=8.6 Hz, 1H)

(1S,2R,3R,4R,5S)-2,3-bis(benzyloxy)-1-[(benzyloxy)methyl]-6,8-dioxabicyclo[3.2.1]octan-4-amine (1-n-1)

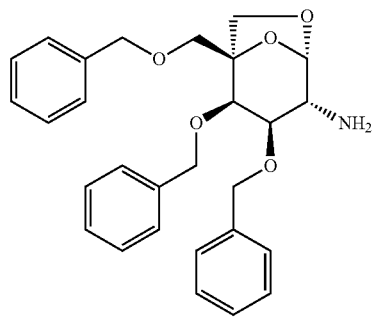 [SMILES: N[C@H]1[C@H]2OC[C@](COCc3ccccc3)(O2)[C@H](OCc2ccccc2)[C@@H]1OCc1ccccc1]

A mixture of (1S,2R,3R,4R,5S)-4-azido-2,3-bis(benzyloxy)-1-[(benzyloxy)methyl]-6,8-dioxabicyclo[3.2.1]octane (I-m-1) (310 mg, 0.64 mmol), triphenylphosphine (334 mg, 1.27 mmol), water (92 mg, 5.1 mmol), and tetrahydrofuran (10 mL) was stirred at 65° C. for 16 hours. The reaction mixture was concentrated under reduced pressure and the residue was loaded on a silica gel column. Chromatography eluting with a gradient from 20% to 80% of ethyl acetate in heptane gave the title product as a colorless gum (210 mg, 72%). $^1$H NMR (CHLOROFORM-d) δ: 7.20-7.37 (m, 15H), 5.29 (d, J=1.2 Hz, 1H), 4.90 (d, 11.5 Hz, 1H), 4.79 (d, J=11.5 Hz, 1H), 4.57 (d, J=11.7 Hz, 1H), 4.56 (d, J=12.1 Hz, 1H), 4.43 (d, J=12.1 Hz, 1H), 4.39 (d, J=11.7 Hz, 1H), 3.97 (d, J=3.9 Hz, 1H), 3.90 (d, J=9.0 Hz, 1H), 3.69 (d, J=8.2 Hz, 1H), 3.59 (d, J=8.2 Hz, 1H), 3.42 (d, J=8.6 Hz, 1H), 3.37 (dd, J=9.4, 3.5 Hz, 1H), 3.07 (dd, J=9.4, 1.2 Hz, 1H); $^{13}$C NMR (CHLOROFORM-d) δ: 131.8, 131.6, 131.5, 128.2, 128.2, 128.1, 128.1, 128.0, 127.7, 127.6, 127.6, 127.4, 103.5, 82.6, 80.3, 74.5, 73.3, 73.1, 72.2, 69.9, 69.3, 55.1; LCMS (ES+): 1.18 min, 484.2 (M+Na)$^+$.

N-{(1S,2R,3R,4R,5S)-2,3-bis(benzyloxy)-1-[(benzyloxy)methyl]-6,8-dioxabicyclo[3.2.1]oct-4-yl}acetamide (I-n-2)

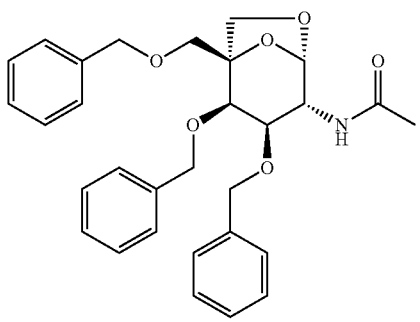

To a stirred mixture of (1S,2R,3R,4R,5S)-2,3-bis(benzyloxy)-1-[(benzyloxy)methyl]-6,8-dioxabicyclo[3.2.1]octan-4-amine (1-n-1) (25 mg, 0.054 mmol), pyridine (43 mg, 0.54 mmol), and 2-methyl-tetrahydrofuran (1 mL) was added acetic anhydride (46 mg, 0.43 mmol) in one portion at room temperature. The reaction mixture was stirred at room temperature for 16 hours and partitioned between ethyl acetate and water. The organic extract was washed with brine, dried over anhydrous magnesium sulfate, and concentrated under reduced pressure. The residue was purified on a silica gel column, eluting with a gradient from 20% to 60% of ethyl acetate in heptane to obtain the title product as a white solid (20 mg, 73%). $^1$H NMR (CHLOROFORM-d) δ: 7.24-7.43 (m, 15H), 5.35 (d, J=1.2 Hz, 1H), 5.06 (d, J=8.6 Hz, 1H), 4.96 (d, J=11.3 Hz, 1H), 4.74 (d, J=12.5 Hz, 1H), 4.58 (d, J=11.3 Hz, 1H), 4.42 (d, J=12.5 Hz, 1H), 4.40 (s, 2H), 4.30-4.36 (m, 1H), 4.04 (d, J=3.9 Hz, 1H), 3.96 (d, J=8.6 Hz, 1H), 3.67-3.70 (m, 1H), 3.58-3.61 (m, 1H), 3.41-3.47 (m, 2H), 1.87 (s, 3H); $^{13}$C NMR (CHLOROFORM-d) δ: 170.0, 138.2, 137.8, 137.4, 128.7, 128.5, 128.4, 128.3, 128.3, 128.2, 128.1, 128.0, 127.8, 101.6, 82.8, 75.7, 75.0, 73.8, 73.2, 71.5, 70.1, 69.5, 53.5, 23.3; LCMS (ES+): 1.87 min, 526.3 (M+Na)⁺.

N-{(1S,2R,3R,4R,5S)-2,3-bis(benzyloxy)-1-[(benzyloxy)methyl]-6,8-dioxabicyclo[3.2.1]oct-4-yl}-2,2,2-trifluoroacetamide (1-n-3)

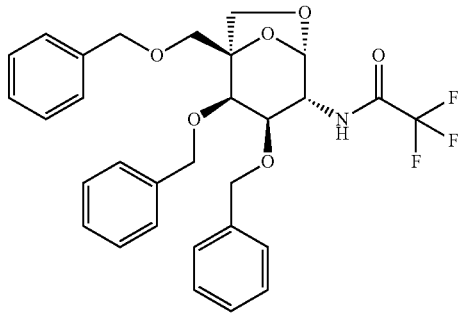 [SMILES: O=C(N[C@H]1[C@H]2OC[C@](COCc3ccccc3)(O2)[C@H](OCc2ccccc2)[C@@H]1OCc1ccccc1)C(F)(F)F]

To a stirred mixture of (1S,2R,3R,4R,5S)-2,3-bis(benzyloxy)-1-((benzyloxy)methyl)-6,8-dioxabicyclo[3.2.1]octan-4-amine (1-n-1) (75 mg, 0.16 mmol), pyridine (129 mg, 1.62 mmol), and 2-methyl-tetrahydrofuran (1 mL) was added trifluoroacetic anhydride (102 mg, 0.49 mmol) in one portion at room temperature. The reaction mixture was stirred at room temperature for 16 hours and partitioned between ethyl acetate and water. The organic extract was washed with brine, dried over anhydrous magnesium sulfate, and concentrated under reduced pressure. The residue was purified on a silica gel column, eluting with a gradient from 10% to 40% of ethyl acetate in heptane to obtain the title product as a white solid (60 mg, 66%). ¹H NMR (CHLOROFORM-d) δ: 7.25-7.42 (m, 15H), 5.91 (d, J=8.6 Hz, 1H), 5.35 (d, J=1.2 Hz, 1H), 4.95 (d, J=11.3 Hz, 1H), 4.72 (d, J=12.5 Hz, 1H), 4.58 (d, J=11.3 Hz, 1H), 4.41 (s, 2H), 4.40 (d, J=12.5 Hz, 1H), 4.36 (t, J=9.8 Hz, 1H), 4.08 (d, J=3.9 Hz, 1H), 3.96 (d, J=9.0 Hz, 1H), 3.68-3.72 (m, 1H), 3.60-3.63 (m, 1H), 3.50 (dd, J=10.0, 3.7 Hz, 1H), 3.45 (d, J=8.6 Hz, 1H); ¹³C NMR (CHLOROFORM-d) δ: 137.9, 137.1, 136.1, 128.9, 128.5, 128.5, 128.4, 128.4, 128.1, 128.1, 128.1, 127.9, 100.6, 83.0, 75.0, 74.9, 73.8, 72.7, 71.4, 70.3, 69.2, 54.1; ¹⁹F NMR (CHLOROFORM-d) δ: −75.7 (s); LCMS (ES−): 2.11 min, 556.2 (M−H)⁻.

N-{(1S,2R,3R,4R,5S)-2,3-bis(benzyloxy)-1-[(benzyloxy)methyl]-6,8-dioxabicyclo[3.2.1]oct-4-yl}methanesulfonamide (1-n-4)

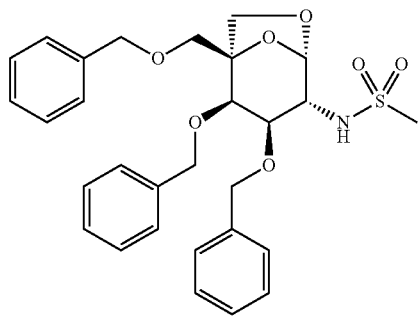 [SMILES: CS(=O)(=O)N[C@H]1[C@H]2OC[C@](COCc3ccccc3)(O2)[C@H](OCc2ccccc2)[C@@H]1OCc1ccccc1]

To a stirred mixture of (1S,2R,3R,4R,5S)-2,3-bis(benzyloxy)-1-((benzyloxy)methyl)-6,8-dioxabicyclo[3.2.1]octan-4-amine (1-n-1) (50 mg, 0.11 mmol), triethylamine (0.100 mL, 0.72 mmol), and 2-methyl-tetrahydrofuran (1 mL) was added methansulfonyl chloride (0.025 mL, 0.33 mmol) drop wise at 0° C. The reaction mixture was stirred at room temperature for 16 hours and partitioned between ethyl acetate and saturated aqueous sodium bicarbonate. The organic extract was washed with water, brine, dried over anhydrous magnesium sulfate, and concentrated under reduced pressure. The residue was purified on a silica gel column, eluting with a gradient from 10% to 50% of ethyl acetate in heptane to obtain the title product as a white solid (58 mg, 65%). ¹H NMR (CHLOROFORM-d) δ: 7.22-7.41 (m, 15H), 5.43 (d, J=1.2 Hz, 1H), 4.93 (d, J=11.3 Hz, 1H), 4.79 (d, J=11.7 Hz, 1H), 4.62 (br.s., 1H), 4.56 (d, J=11.7 Hz, 1H), 4.54 (d, J=11.3 Hz, 1H), 4.41 (d, J=12.1 Hz, 1H), 4.37 (d, J=12.1 Hz, 1H), 4.05 (d, J=3.9 Hz, 1H), 3.92 (d, J=8.6 Hz, 1H), 3.74 (d, J=8.6 Hz, 1H), 3.68-3.72 (m, 1H), 3.62 (d, J=8.6 Hz, 1H), 3.54 (dd, J=10.0, 3.7 Hz, 1H), 3.44 (d, J=9.0 Hz, 1H), 2.90 (s, 3H); ¹³C NMR (CHLOROFORM-d) δ: 138.0, 137.3, 137.2, 128.7(2), 128.5(2), 128.4(2), 128.3, 128.1(2), 128.1, 127.9(2), 127.8(2), 102.7, 82.9, 77.2, 77.1, 75.0, 73.7, 73.5, 72.8, 70.2, 69.3, 57.7, 41.2; LCMS (ES−): 1.97 min, 538.3 (M−H)⁻.

N-{(1S,2R,3R,4R,5S)-2,3-bis(benzyloxy)-1-[(benzyloxy)methyl]-6,8-dioxabicyclo[3.2.1]oct-4-yl}propanamide (1-n-5)

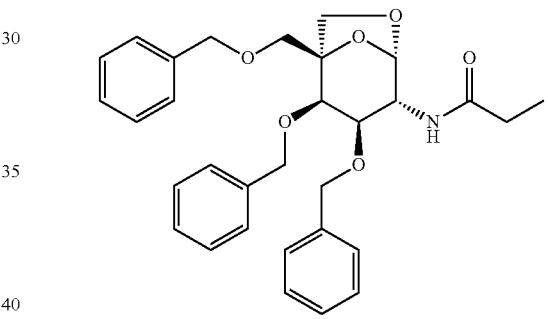

To a stirred mixture of propionic acid (23 mg, 0.31 mmol) in tetrahydrofuran (1 mL) was added 1,1'-carbonyldiimidazole (33 mg, 0.20 mmol) in one portion at room temperature and the clear solution was stirred at room temperature for 3 hours. Triethylamine (0.028 mL, 0.20 mmol) and (1S,2R,3R,4R,5S)-2,3-bis(benzyloxy)-1-((benzyloxy)methyl)-6,8-dioxabicyclo[3.2.1]octan-4-amine (1-n-1) (47 mg, 0.10 mmol) were added in one portion at room temperature. The reaction mixture was stirred at room temperature for 16 hours and partitioned between ethyl acetate (3 mL), brine (2 mL), and water (2 mL). The organic extract was washed with brine, dried over anhydrous magnesium sulfate, and concentrated under reduced pressure. The residue was purified on a silica gel column, eluting with a gradient from 10% to 50% of ethyl acetate in heptane to obtain the title product as a white solid (43 mg, 82%). ¹H NMR (CHLOROFORM-d) δ: 7.03-7.58 (m, 15H), 5.35 (s, 1H), 5.09 (d, J=8.2 Hz, 1H), 4.95 (d, J=11.3 Hz, 1H), 4.72 (d, J=12.1 Hz, 1H), 4.57 (d, J=11.3 Hz, 1H), 4.43 (d, J=12.1 Hz, 1H), 4.39 (s, 2H), 4.31-4.38 (m, 1H), 4.04 (d, J=3.9 Hz, 1H), 3.95 (d, J=9.0 Hz, 1H), 3.68 (d, J=8.2 Hz, 1H), 3.59 (d, J=8.2 Hz, 1H), 3.44-3.49 (m, 1H), 3.44 (d, J=8.6 Hz, 1H), 2.08 (q, J=7.4 Hz, 2H), 1.11 (t, J=7.6 Hz, 3H); ¹³C NMR (CHLOROFORM-d) δ: 173.5, 138.1, 137.8, 137.4, 128.6, 128.5, 128.3, 128.3, 128.2, 128.1, 128.0, 128.0, 127.7, 101.6, 82.7, 75.7, 74.9, 73.7, 73.2, 71.5, 70.1, 69.4, 53.3, 29.6, 9.5; LCMS (ES−): 1.94 min, 516.4 (M−H)⁻; LCMS (AP+): 1.94 min, 518.5 (M+H)⁺.

N-{(1S,2R,3R,4R,5S)-2,3-bis(benzyloxy)-1-[(benzyloxy)methyl]-6,8-dioxabicyclo[3.2.1]oct-4-yl}-3,3,3-trifluoropropanamide (1-n-6)

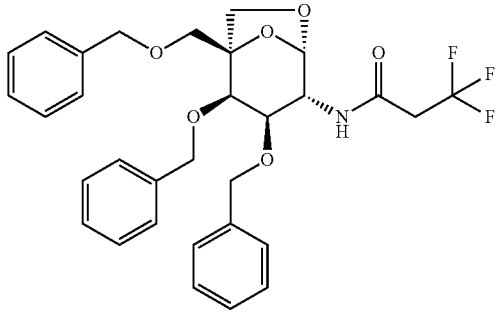 [SMILES: O=C(CC(F)(F)F)N[C@H]1[C@H]2OC[C@](COCc3ccccc3)(O2)[C@H](OCc2ccccc2)[C@@H]1OCc1ccccc1]

To a stirred mixture of 3,3,3-trifluoropropionic acid (39 mg, 0.31 mmol) in tetrahydrofuran (1 mL) was added 1,1'-carbonyldiimidazole (33 mg, 0.20 mmol) in one portion at room temperature and the clear solution was stirred at room temperature for 3 hours. Triethylamine (0.028 mL, 0.20 mmol) and (1S,2R,3R,4R,5S)-2,3-bis(benzyloxy)-1-((benzyloxy)methyl)-6,8-dioxabicyclo[3.2.1]octan-4-amine (1-n-1) (47 mg, 0.10 mmol) were added in one portion at room temperature. The reaction mixture was stirred at room temperature for 16 hours and partitioned between ethyl acetate (3 mL), brine (2 mL), and water (2 mL). The organic extract was washed with brine, dried over anhydrous magnesium sulfate, and concentrated under reduced pressure. The residue was subjected to chromatography on a silica gel column, eluting with a gradient from 10% to 50% of ethyl acetate in heptane to obtain the title product as a white solid (40 mg, 69%). $^1$H NMR (CHLOROFORM-d) δ: 7.24-7.42 (m, 15H), 5.37 (d, J=8.6 Hz, 1H), 5.35 (d, J=1.6 Hz, 1H), 4.95 (d, J=11.3 Hz, 1H), 4.71 (d, J=12.1 Hz, 1H), 4.56 (d, J=11.3 Hz, 1H), 4.45 (d, J=12.1 Hz, 1H), 4.40 (s, 2H), 4.35-4.40 (m, 1H), 4.05 (d, J=3.5 Hz, 1H), 3.95 (d, J=8.6 Hz, 1H), 3.71 (d, J=8.2 Hz, 1H), 3.61 (d, J=8.2 Hz, 1H), 3.50 (dd, J=10.0, 3.7 Hz, 1H), 3.45 (d, J=8.6 Hz, 1H), 2.92 (q, J=10.5 Hz, 2H); $^{13}$C NMR (CHLOROFORM-d) δ: 162.3, 138.0, 137.6, 137.3, 128.7, 128.5, 128.4, 128.3, 128.3, 128.2, 128.0, 128.0, 127.8, 101.1, 82.8, 75.8, 75.0, 73.7, 73.2, 71.9, 70.2, 69.3, 54.0, 41.7; $^{19}$F NMR (CHLOROFORM-d) δ: −62.8 (s); LCMS (ES−): 2.05 min, 570.3 (M−H)⁻.

N-{(1S,2R,3R,4R,5S)-2,3-bis(benzyloxy)-1-[(benzyloxy)methyl]-6,8-dioxabicyclo[3.2.1]oct-4-yl}-2,2-difluoroacetamide (1-n-7)

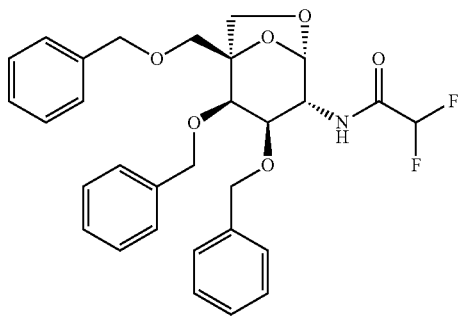 [SMILES: O=C(N[C@H]1[C@H]2OC[C@](COCc3ccccc3)(O2)[C@H](OCc2ccccc2)[C@@H]1OCc1ccccc1)C(F)F]

To a stirred mixture of difluoroacetic acid (29 mg, 0.31 mmol) in N,N-dimethylformamide (1 mL) was added 1,1'-carbonyldiimidazole (33 mg, 0.20 mmol) in one portion at room temperature and the clear solution was stirred at room temperature for 3 hours. Triethylamine (0.028 mL, 0.20 mmol) and (1S,2R,3R,4R,5S)-2,3-bis(benzyloxy)-1-((benzyloxy)methyl)-6,8-dioxabicyclo[3.2.1]octan-4-amine (1-n-1) (47 mg, 0.10 mmol) were added in one portion at room temperature. The reaction mixture was stirred at room temperature for 16 h and partitioned between ethyl acetate (3 mL), brine (2 mL), and water (2 mL). The organic extract was washed with brine, dried over anhydrous magnesium sulfate, and concentrated. The residue was subjected to chromatography on a silica gel column, eluting with a gradient from 10% to 50% of ethyl acetate in heptane to obtain the title product as a white solid (32 mg, 58%). $^1$H NMR (CHLOROFORM-d) δ: 7.14-7.47 (m, 15H), 6.02 (d, J=8.6 Hz, 1H), 5.83 (t, J=54.2 Hz, 1H), 5.35 (s, 1H), 4.96 (d, J=11.3 Hz, 1H), 4.73 (d, J=12.5 Hz, 1H), 4.58 (d, J=11.3 Hz, 1H), 4.45 (d, J=12.1 Hz, 1H), 4.41 (s, 2H), 4.34-4.40 (m, 1H), 4.08 (d, J=3.9 Hz, 1H), 3.96 (d, J=9.0 Hz, 1H), 3.67-3.75 (m, 1H), 3.59-3.65 (m, 1H), 3.53 (dd, J=9.8, 3.9 Hz, 1H), 3.46 (d, J=8.6 Hz, 1H); $^{13}$C NMR (CHLOROFORM-d) δ: 162.6, 138.0, 137.3, 128.8, 128.5, 128.4, 128.3, 128.1, 128.0, 127.8, 108.3 (t, J=253.1 Hz), 100.9, 82.9, 75.3, 75.0, 73.8, 72.9, 71.6, 70.2, 69.3, 53.5; $^{19}$F NMR (CHLOROFORM-d) δ: −126.1 (d, J=53.1 Hz); LCMS (ES−): 2.05 min, 538.2 (M−H)⁻.

tert-butyl {(1S,2R,3R,4R,5S)-2,3-bis(benzyloxy)-1-[(benzyloxy)methyl]-6,8-dioxabicyclo[3.2.1]oct-4-yl}carbamate (I-n-8)

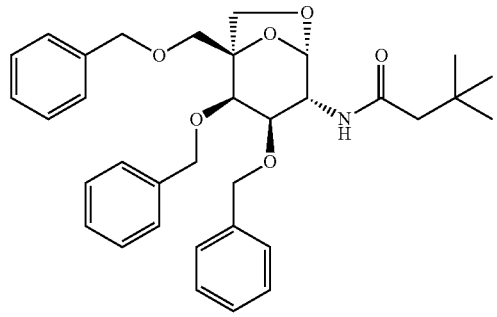 [SMILES: CC(C)(C)CC(=O)N[C@H]1[C@H]2OC[C@](COCc3ccccc3)(O2)[C@H](OCc2ccccc2)[C@@H]1OCc1ccccc1]

To a stirred mixture of (1S,2R,3R,4R,5S)-2,3-bis(benzyloxy)-1-((benzyloxy)methyl)-6,8-dioxabicyclo[3.2.1]octan-4-amine (1-n-1) (120 mg, 0.26 mmol) and N,N-dimethylaminopyridine (DMAP) (6.4 mg, 0.052 mmol), and tetrahydrofuran (2 mL) was added di-tert-butyl dicarbonate (113 mg, 0.52 mmol) in one portion at room temperature. The reaction mixture was stirred at room temperature for 16 hours and concentrated under reduced pressure. The residue was purified on a silica gel column, eluting with a gradient from 10% to 40% of ethyl acetate in heptane to obtain the title product as a white solid (104 mg, 71%). $^1$H NMR (CHLOROFORM-d) δ: 7.17-7.45 (m, 15H), 5.35 (s, 1H), 4.97 (d, J=11.3 Hz, 1H), 4.74 (d, J=12.1 Hz, 1H), 4.57 (d, J=11.3 Hz, 2H), 4.47 (d, J=7.0 Hz, 1H), 4.39 (s, 2H), 4.09 (br. s., 1H), 4.01 (d, J=3.9 Hz, 1H), 3.93 (d, J=9.0 Hz, 1H), 3.63-3.71 (m, 1H), 3.54-3.62 (m, 1H), 3.38-3.48 (m, 2H), 1.47 (s, 9H); $^{13}$C NMR (CHLOROFORM-d) δ: 155.2, 138.2, 137.8, 137.4, 128.5, 128.4, 128.3, 128.3, 128.0, 127.9, 127.8, 127.7, 102.2, 82.8, 79.4, 74.8, 73.7, 73.4, 72.0, 70.0, 69.4, 54.6, 31.9, 28.4; LCMS (AP+): 2.25 min, 462.2 (M-Boc-FH)+.

N-[(1S,2R,3R,4R,5S)-2,3-dihydroxy-1-(hydroxymethyl)-6,8-dioxabicyclo[3.2.1]oct-4-yl]propanamide (25)

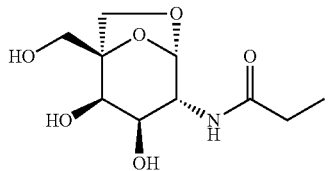

A mixture of N-((1S,2R,3R,4R,5S)-2,3-bis(benzyloxy)-1-((benzyloxy)methyl)-6,8-dioxabicyclo[3.2.1]octan-4-yl) propionamide (1-n-5) (42 mg, 0.081 mmol), 1-methyl-1,4-cyclohexadiene (0.093 mL, 0.81 mmol), 10% Pd on activated carbon (20 mg), and 2-propanol (2.5 mL) was stirred at 80° C. for 3 hours. Water (0.2 ml) was added and the whole mixture was loaded on silica gel and dried on a rotary evaporator. The material was purified on a silica gel column eluting with a gradient from 4% to 15% of methanol in dichloromethane gave the title compound as a colorless gum (12 mg, 60%). $^1$H NMR (METHANOL-$d_4$) δ: 5.21 (d, J=1.6 Hz, 1H), 3.95 (dd, J=10.1, 1.2 Hz, 1H), 3.92 (d, J=11.3 Hz, 1H), 3.87 (d, J=3.9 Hz, 1H), 3.81 (d, J=11.3 Hz, 1H), 3.75 (d, J=8.2 Hz, 1H), 3.71-3.76 (m, 2H), 3.68 (d, J=8.2 Hz, 1H) 3.35 (s, 1H), 2.26 (q, J=7.4 Hz, 2H), 1.13 (t, J=7.4 Hz, 3H); $^{13}$C NMR (METHANOL-$d_4$) δ: 177.7, 102.6, 84.9, 70.4, 69.1, 69.0, 61.9, 56.0, 30.0, 10.3; LCMS (AP+): 0.25 min, 248.2 (M+H)+.

N-[(1S,2R,3R,4R,5S)-2,3-dihydroxy-1-(hydroxymethyl)-6,8-dioxabicyclo[3.2.1]oct-4-yl]-2,2,2-trifluoroacetamide (24)

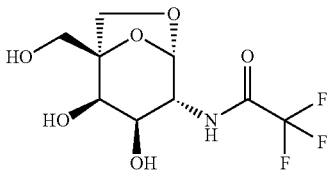 [SMILES: O=C(N[C@H]1[C@H]2OC[C@](CO)(O2)[C@H](O)[C@@H]1O)C(F)(F)F]

A mixture of N-((1S,2R,3R,4R,5S)-2,3-bis(benzyloxy)-1-((benzyloxy)methyl)-6,8-dioxabicyclo[3.2.1]octan-4-yl)-2,2,2-trifluoroacetamide (1-n-3) (20 mg, 0.036 mmol), 1-methyl-1,4-cyclohexadiene (0.093 mL, 0.81 mmol), 10% Pd on activated carbon (20 mg), and 2-propanol (2.5 mL) was stirred at 80° C. for 3 hours. Water (0.2 ml) was added and the whole mixture was loaded on silica gel and dried on a rotary evaporator. The material was purified on a silica gel column, eluting with a gradient from 4% to 15% of methanol in dichloromethane gave the title compound as a colorless gum (7.2 mg, 69%). $^1$H NMR (METHANOL-$d_4$) δ: 5.25 (d, J=1.2 Hz, 1H), 4.02 (d, J=8.6 Hz, 1H), 3.90 (d, J=7.0 Hz, 1H), 3.88-3.95 (m, 2H), 3.82 (d, J=11.7 Hz, 1H), 3.78 (d, J=7.8 Hz, 1H), 3.71 (d, J=7.8 Hz, 1H), 3.35 (s, 1H); $^{13}$C NMR (METHANOL-$d_4$) δ: 159.8, 102.3, 85.5, 70.8, 69.7, 68.4, 62.2, 57.4; $^{19}$F NMR (CHLOROFORM-d) δ: −77.0 (s); LCMS (AP+): 0.42 min, 288.2 (M+H)+.

N-[(1S,2R,3R,4R,5S)-2,3-dihydroxy-1-(hydroxymethyl)-6,8-dioxabicyclo[3.2.1]oct-4-yl]methanesulfonamide (26)

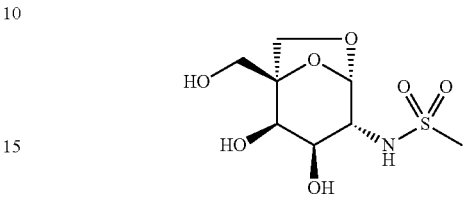

A mixture of N-((1S,2R,3R,4R,5S)-2,3-bis(benzyloxy)-1-((benzyloxy)methyl)-6,8-dioxabicyclo[3.2.1]octan-4-yl) methanesulfonamide (1-n-4) (19 mg, 0.035 mmol), 1-methyl-1,4-cyclohexadiene (0.093 mL, 0.81 mmol), 10% Pd on activated carbon (20 mg), and 2-propanol (2.5 mL) was stirred at 80° C. for 3 hours. Water (0.2 ml) was added and the whole mixture was loaded on silica gel and dried on a rotary evaporator. The material was purified on a silica gel column, eluting with a gradient from 4% to 15% of methanol in dichloromethane gave the title compound as a colorless gum (6.4 mg, 68%). $^1$H NMR (METHANOL-$d_4$) δ: 5.26 (d, J=1.6 Hz, 1H), 3.91 (d, J=11.3 Hz, 1H), 3.87 (d, J=4.3 Hz, 1H), 3.80 (d, J=11.3 Hz, 1H), 3.73 (d, J=7.8 Hz, 1H), 3.68 (d, J=7.8 Hz, 1H), 3.66-3.71 (m, 1H), 3.37 (dd, J=9.8, 1.6 Hz, 1H), 3.35 (s, 1H), 3.04 (s, 3H); $^{13}$C NMR (METHANOL-$d_4$) δ: 104.6, 85.1, 70.9, 69.8, 69.3, 62.0, 60.2, 41.7; LCMS (ES−): 0.15 min, 268.0 (M−H)−.

N-[(1S,2R,3R,4R,5S)-2,3-dihydroxy-1-(hydroxymethyl)-6,8-dioxabicyclo[3.2.1]oct-4-yl]-2,2-difluoroacetamide (27)

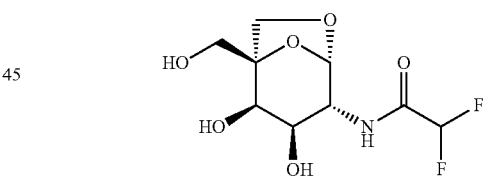

To a solution of N-{(1S,2R,3R,4R,5S)-2,3-bis(benzyloxy)-1-[(benzyloxy)methyl]-6,8-dioxabicyclo[3.2.1]oct-4-yl}-2,2-difluoroacetamide (1-n-7) (32.0 mg, 0.059 mmol) in 2-propanol (1.0 mL) and tetrahydrofuran (0.5 mL) in a 5 mL microwave vial was added 1-methyl-1,4-cyclohexadiene (0.2 mL, 2 mmol) followed by the addition of 10% Palladium on carbon (50% wet wt/wt, 20.0 mg, 0 mmol). The vial was sealed and heated to 80° C. for 4 hours. After 4 hours, the TLC (10% methanol/dichloromethane) showed that the reaction was not complete but there was formation of the desired product. An additional 1-methyl-1,4-cyclohexadiene (0.2 mL mg, 2 mmol) was added and the reaction was resealed and heated to 80° C. overnight (18 hours). After 22 total hours, the reaction was diluted with methanol and filtered through a Life Sciences Acrodisc 25 mm syringe filter. The filtrate was concentrated under reduced pressure. The crude material was purified using the CombiFlash Rf (RediSep 4 g silica gel column) and eluting with a gradient of 0-20% methanol/dichloromethane yielding the title compound as a solid (5.0 mg, SOLID, 31%). -Method C: 3 minute run LRMS [M+Na=292]. $^1$H NMR (METHANOL-d$_4$) δ: 6.06 (t, J=54.2 Hz, 1H), 5.25 (s, 1H), 4.02 (d, J=9.4 Hz, 1H), 3.92 (d, J=11.7 Hz, 1H), 3.84-3.90 (m, 2H), 3.81 (d, J=11.7 Hz, 1H), 3.78 (d, J=8.2 Hz, 1H), 3.70 (d, J=8.2 Hz, 1H)

N-[(1S,2R,3R,4R,5S)-2,3-dihydroxy-1-(hydroxymethyl)-6,8-dioxabicyclo[3.2.1]oct-4-yl]-3,3,3-trifluoropropanamide (28)

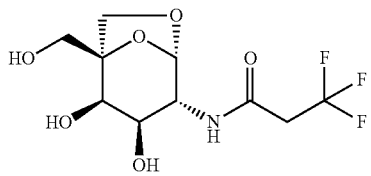 [SMILES: O=C(CC(F)(F)F)N[C@H]1[C@H]2OC[C@](CO)(O2)[C@H](O)[C@@H]1O]

To a solution of N-{(1S,2R,3R,4R,5S)-2,3-bis(benzyloxy)-1-[(benzyloxy)methyl]-6,8-dioxabicyclo[3.2.1]oct-4-yl}-3,3,3-trifluoropropanamide (1-n-6) (40.0 mg, 0.070 mmol) in 2-propanol (1.0 mL) and tetrahydrofuran (0.5 mL) in a 5 mL microwave vial was added 1-methyl-1,4-cyclohexadiene (0.2 mL, 1.75 mmol) followed by the addition of 10% palladium on carbon (50% wet wt/wt., 20.0 mg, 0 mmol). The vial was sealed and heated to 80° C. for 4 hours. After 4 hours, the reaction was diluted with methanol and filtered through a Life Sciences Acrodisc 25 mm syringe filter. The filtrate was concentrated under reduced pressure. The crude material was purified using the CombiFlash Rf (RediSep 4 g silica gel column) and eluting with a gradient of 0-20% methanol/dichloromethane yielding the title compound as a solid (15.3 mg, 73%). LRMS [M+1=302]. $^1$H NMR (METHANOL-d$_4$) δ: 5.23 (s, 1H), 3.99 (d, J=9.8 Hz, 1H), 3.92 (d, J=11.3 Hz, 1H), 3.87 (d, J=4.3 Hz, 1H), 3.81 (d, J=11.3 Hz, 1H), 3.76 (d, J=8.2 Hz, 1H), 3.71-3.74 (m, 1H), 3.69 (d, J=8.2 Hz, 1H), 3.22 (qd, J=10.7, 2.5 Hz, 2H)

N-{(1S,2R,3R,4R,5S)-2,3-bis(benzyloxy)-1-[(benzyloxy)methyl]-6,8-dioxabicyclo[3.2.1]oct-4-yl}-N-methylacetamide (I-o-1)

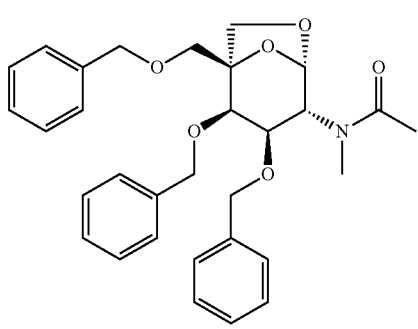 [SMILES: CC(=O)N(C)[C@H]1[C@H]2OC[C@](COCc3ccccc3)(O2)[C@H](OCc2ccccc2)[C@@H]1OCc1ccccc1]

To a stirred mixture of N-((1S,2R,3R,4R,5S)-2,3-bis(benzyloxy)-1-((benzyloxy)methyl)-6,8-dioxabicyclo[3.2.1]octan-4-yl)acetamide (I-n-2) (19 mg, 0.038 mmol) and N,N-dimethylformamide (1.5 mL) was added sodium hydride (60% suspension in mineral oil) in one portion at room temperature and the mixture was stirred for 30 minutes. Iodomethane (16 mg, 0.11 mmol) was added in one portion at room temperature. The reaction mixture was stirred at room temperature for 16 hours and partitioned between ethyl acetate (3 mL), brine (2 mL), and water (2 mL). The organic extract was washed with brine, dried over anhydrous magnesium sulfate, and concentrated under reduced pressure. The residue was purified on a silica gel column, eluting with a gradient from 10% to 50% of ethyl acetate in heptane to obtain the title product as a colorless gum (19 mg, 97%). Mixture of rotamers (3:1). Rotamer 1: $^1$H NMR (CHLOROFORM-d) d: 7.21-7.43 (m, 15H), 5.37 (s, 1H), 4.93 (d, J=10.9 Hz, 1H), 4.65 (d, J=11.7 Hz, 1H), 4.54 (d, J=11.3 Hz, 1H), 4.50 (d, J=11.7 Hz, 1H), 4.37-4.45 (m, 2H), 4.15 (d, J=9.8 Hz, 1H), 4.09 (d, J=3.5 Hz, 1H), 3.93 (d, J=8.6 Hz, 1H), 3.85 (dd, J=10.1, 3.5 Hz, 1H), 3.78 (d, J=8.2 Hz, 1H), 3.64 (d, J=8.2 Hz, 1H), 3.45 (d, J=8.6 Hz, 1H), 2.80 (s, 3H), 2.19 (s, 3H); rotomer2: $^1$H NMR (CHLOROFORM-d) d: 7.21-7.43 (m, 15H), 5.27 (s, 1H), 5.12 (d, J=10.9 Hz, 1H), 4.94-4.98 (m, 1H), 4.74 (d, J=12.1 Hz, 1H), 4.56 (d, J=11.7 Hz, 1H), 4.46 (d, J=11.3 Hz, 1H), 4.37-4.46 (m, 2H), 4.14-4.17 (m, 1H), 3.97 (d, J=8.6 Hz, 1H), 3.82-3.89 (m, 2H), 3.79 (d, J=8.2 Hz, 1H), 3.60-3.63 (m, 1H), 2.71 (s, 3H), 2.08 (s, 3H); $^{13}$C NMR (CHLOROFORM-d) d: 172.2, 138.0, 137.3, 137.2, 128.6, 128.5, 128.5, 128.4, 128.1, 128.0, 127.9, 127.9, 127.9, 127.8, 103.2, 83.2, 75.2, 74.1, 73.8, 73.7, 73.0, 72.4, 70.1, 69.2, 61.2, 28.0, 22.2; LCMS (AP+): 1.99 min, 518.0 (M+H)$^+$.

N-{(1S,2R,3R,4R,5S)-2,3-bis(benzyloxy)-1-[(benzyloxy)methyl]-6,8-dioxabicyclo[3.2.1]oct-4-yl}-N-methylmethanesulfonamide (I-o-2)

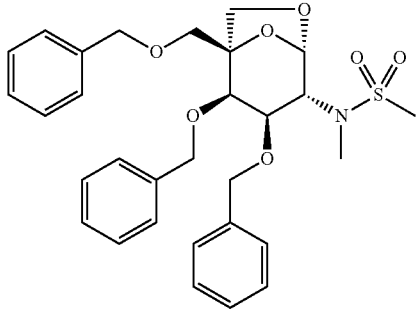 [SMILES: CN([C@H]1[C@H]2OC[C@](COCc3ccccc3)(O2)[C@H](OCc2ccccc2)[C@@H]1OCc1ccccc1)S(C)(=O)=O]

To a stirred mixture of N-((1S,2R,3R,4R,5S)-2,3-bis(benzyloxy)-1-((benzyloxy)methyl)-6,8-dioxabicyclo[3.2.1]octan-4-yl)methanesulfonamide (1-n-4) (19 mg, 0.035 mmol) and N,N-dimethylformamide (1.5 mL) was added sodium hydride (60% suspension in mineral oil) in one portion at room temperature and the mixture was stirred for 30 min. Iodomethane (16 mg, 0.11 mmol) was added in one portion at room temperature. The reaction mixture was stirred at room temperature for 16 hours and partitioned between ethyl acetate (3 mL), brine (2 mL), and water (2 mL). The organic extract was washed with brine, dried over anhydrous magnesium sulfate, and concentrated under reduced pressure. The residue was purified on a silica gel column, eluting with a gradient from 10% to 50% of ethyl acetate in heptane to obtain the title product as a colorless gum (11 mg, 56%). $^1$H NMR (CHLOROFORM-d) δ: 7.25-7.39 (m, 15H), 5.39 (d, J=0.8 Hz, 1H), 4.93 (d, J=11.7 Hz, 1H), 4.80 (d, J=11.3 Hz, 1H), 4.58 (d, J=11.3 Hz, 1H), 4.45 (d, J=11.7 Hz, 1H), 4.43 (d, J=11.7 Hz, 1H), 4.41 (d, J=11.7 Hz, 1H), 4.21 (d, J=3.5 Hz, 1H), 4.18 (d, J=10.5 Hz, 1H), 3.98 (d, J=8.6 Hz, 1H), 3.87 (dd, J=10.5, 3.9 Hz, 1H), 3.82 (d, J=8.6 Hz, 1H), 3.62 (d, J=8.2 Hz, 1H), 3.45 (d, J=9.0 Hz, 1H), 2.83 (s, 3H), 2.68 (s, 3H); $^{13}$C NMR (CHLOROFORM-d) δ: 138.1, 137.3, 136.8, 128.7, 128.5, 128.4, 128.4, 128.1, 128.1, 128.0, 127.8, 104.6, 82.9, 74.9, 73.8, 73.5, 73.3, 71.6, 70.3, 69.4, 59.7, 37.5, 29.5; LCMS (AP+): 2.08 min, 575.8 (M+Na)$^+$.

tert-butyl {(1S,2R,3R,4R,5S)-2,3-bis(benzyloxy)-1-[(benzyloxy)methyl]-6,8-dioxabicyclo[3.2.1]oct-4-yl}methylcarbamate (I-o-3)

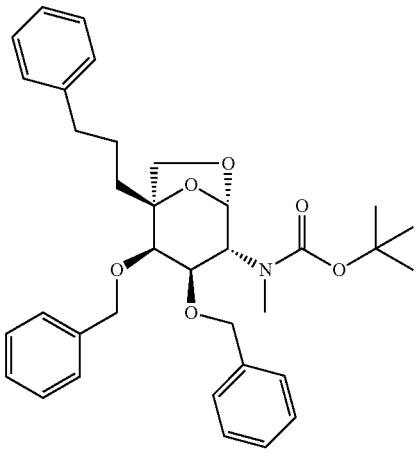 [SMILES: CN(C(=O)OC(C)(C)C)[C@H]1[C@H]2OC[C@](CCCc3ccccc3)(O2)[C@H](OCc2ccccc2)[C@@H]1OCc1ccccc1]

To a stirring solution of tert-butyl {(1S,2R,3R,4R,5S)-2,3-bis(benzyloxy)-1-[(benzyloxy)methyl]-6,8-dioxabicyclo[3.2.1]oct-4-yl}carbamate (I-n-8) (100 mg, 0.178 mmol) in N,N-dimethylformamide (1.5 mL) was added sodium hydride (60% dispersion in mineral oil, 8.55 mg, 0.214 mmol) at room temperature. The reaction was stirred for 1 hour before the addition of iodomethane (0.055 mL, 0.89 mmol). The reaction was allowed to stir overnight at room temperature. After 24 hours, the reaction was quenched with water and extracted three times ethyl acetate. The combined organic layers were washed with water, brine, dried over sodium sulfate, filtered and concentrated under reduced pressure. The crude material was purified using the CombiFlash Rf (RediSep 12 g silica gel column) and eluting with a gradient of 0-100% ethyl acetate/dichloromethane yielding the title compound (78 mg, 76%). Method C: 3 minute run LRMS [M+Na=598]. $^1$H NMR (compound is a mixture of two rotamers ~1:1)

Rotamer 1: $^1$H NMR (METHANOL-d$_4$) δ: 7.08-7.48 (m, 15H), 5.26 (s, 1H), 4.83-4.90 (m, 1H), 4.73 (d, J=11.7 Hz, 1H), 4.47-4.58 (m, 3H), 4.36-4.47 (m, 2H), 4.21 (d, J=3.5 Hz, 1H), 3.98 (dd, J=10.7, 3.3 Hz, 1H), 3.92 (d, J=8.2 Hz, 2H), 3.61 (d, J=7.8 Hz, 1H), 3.47 (dd, J=8.6, 3.9 Hz, 1H), 2.75 (s, 3H), 1.42 (s, 9H)

Rotamer 2: $^1$H NMR (METHANOL-d$_4$) δ: 7.08-7.48 (m, 15H), 5.21 (s, 1H), 4.83-4.90 (m, 1H), 4.73 (d, J=11.7 Hz, 1H), 4.47-4.58 (m, 3H), 4.36-4.47 (m, 2H), 4.21 (d, J=3.5 Hz, 1H), 3.98 (dd, J=10.7, 3.3 Hz, 1H), 3.92 (d, J=8.2 Hz, 2H), 3.61 (d, J=7.8 Hz, 1H), 3.47 (dd, J=8.6, 3.9 Hz, 1H), 2.70 (s, 3H), 1.44-1.52 (m, 9H)

N-[(1S,2R,3R,4R,5S)-2,3-dihydroxy-1-(hydroxymethyl)-6,8-dioxabicyclo[3.2.1]oct-4-yl]-N-methylacetamide (29)

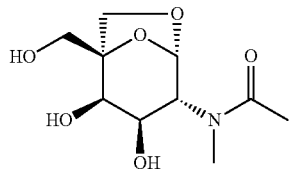 [SMILES: CC(=O)N(C)[C@H]1[C@H]2OC[C@](CO)(O2)[C@H](O)[C@@H]1O]

A mixture of N-((1S,2R,3R,4R,5S)-2,3-bis(benzyloxy)-1-((benzyloxy)methyl)-6,8-dioxabicyclo[3.2.1]octan-4-yl)-N-methylacetamide (I-o-1) (19 mg, 0.037 mmol), 1-methyl-1,4-cyclohexadiene (0.093 mL, 0.81 mmol), 10% Pd on activated carbon (20 mg), and 2-propanol (2.5 mL) was stirred at 80° C. for 3 hours. Water (0.2 ml) was added and the whole mixture was loaded on silica gel and dried on a rotary evaporator. The material was purified on a silica gel column, eluting with a gradient from 4% to 15% of methanol in dichloromethane gave the title compound as a colorless gum (4.3 mg, 47%). $^1$H NMR (mixture of rotomers ~1:1)

Rotamer 1: $^1$H NMR (METHANOL-d$_4$) δ: 5.20 (s, 1H), 4.65 (d, J=10.5 Hz, 1H), 4.02-4.09 (m, 1H), 3.89-3.98 (m, 2H), 3.84 (s, 1H), 3.78-3.82 (m, 1H), 3.68 (s, 1H), 3.11 (s, 3H), 2.15 (s, 3H)

Rotamer 2: $^1$H NMR (METHANOL-d$_4$) δ: 5.37 (s, 1H), 4.02-4.09 (m, 1H), 3.89-3.98 (m, 3H), 3.84-3.87 (m, 1H), 3.79-3.83 (m, 1H), 3.71 (d, J=8.2 Hz, 1H), 2.98 (s, 3H), 2.15 (s, 3H) $^{13}$C NMR (METHANOL-d$_4$) δ: 175.4, 104.6, 85.8, 71.3, 69.7, 66.2, 62.3, 59.1, 28.8, 22.7; LCMS (ES-): 0.41 min, 246.2 (M–H)$^-$.

N-[(1S,2R,3R,4R,5S)-2,3-dihydroxy-1-(hydroxymethyl)-6,8-dioxabicyclo[3.2.1]oct-4-yl]-N-methylmethanesulfonamide (30)

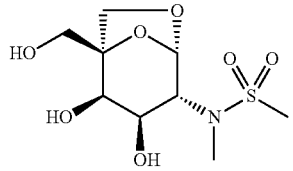 [SMILES: CN([C@H]1[C@H]2OC[C@](CO)(O2)[C@H](O)[C@@H]1O)S(C)(=O)=O]

A mixture of N-((1S,2R,3R,4R,5S)-2,3-bis(benzyloxy)-1-((benzyloxy)methyl)-6,8-dioxabicyclo[3.2.1]octan-4-yl)-N-methylmethanesulfonamide (I-o-2) (11 mg, 0.020 mmol), 1-methyl-1,4-cyclohexadiene (0.093 mL, 0.81 mmol), 10% Pd on activated carbon (20 mg), and 2-propanol (2.5 mL) was stirred at 80° C. for 3 hours. Water (0.2 ml) was added and the whole mixture was loaded on silica gel and dried on a rotary evaporator. Chromatography on a silica gel column, eluting with a gradient from 4% to 15% of methanol in dichloromethane gave the title compound as a colorless gum (2.9 mg, 51%). $^1$H NMR (METHANOL-d$_4$) δ: 5.26 (d, J=1.2 Hz, 1H), 4.00-4.05 (m, 1H), 3.92-3.96 (m, 1H), 3.89-3.91 (m, 1H), 3.84 (d, J=1.2 Hz, 1H), 3.77-3.83 (m, 2H), 3.68 (d, J=7.8

Hz, 1H), 3.35 (s, 3H), 2.93 (s, 3H); $^{13}$C NMR (METHANOL-d$_4$) δ: 106.1, 85.5, 71.5, 69.7, 65.9, 62.6, 62.2, 37.8, 30.4; LCMS (ES−): 0.42 min, 282.0 (M−H)⁻.

tert-butyl [(1S,2R,3R,4R,5S)-2,3-dihydroxy-1-(hydroxymethyl)-6,8-dioxabicyclo[3.2.1]oct-4-yl]methylcarbamate (31)

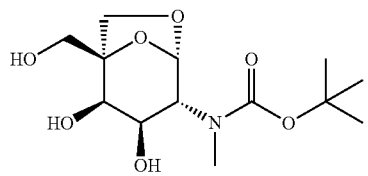 [SMILES: CN(C(=O)OC(C)(C)C)[C@H]1[C@H]2OC[C@](CO)(O2)[C@H](O)[C@@H]1O]

To a solution of tert-butyl {(1S,2R,3R,4R,5S)-2,3-bis(benzyloxy)-1-[(benzyloxy)methyl]-6,8-dioxabicyclo[3.2.1]oct-4-yl}methylcarbamate (I-o-3)(75 mg, 0.13 mmol) in 2-propanol (1.0 mL) and tetrahydrofuran (0.5 mL) in a 5 mL microwave vial was added 1-methyl-1,4-cyclohexadiene (0.18 mL, 1.56 mmol) followed by the addition of 10% palladium on carbon (50% wet wt/wt., 20.0 mg). The vial was sealed and heated to 80° C. for 4 hours. After 4 hours, the TLC (10% methanol/dichloromethane) showed that the reaction was not complete but there was formation of the desired product. An additional 1-methyl-1,4-cyclohexadiene (0.18 mL, 1.6 mmol) was added and the reaction was resealed and heated to 80° C. overnight (18 hours). After 22 total hours, the reaction was diluted with methanol and filtered through a Life Sciences Acrodisc 25 mm syringe filter. The filtrate was concentrated under reduced pressure. The crude material was purified using the CombiFlash Rf (RediSep 4 g silica gel column) and eluting with a gradient of 0-20% methanol/dichloromethane yielding the title compound (29.0 mg, 73%) as a solid. Method C: 3 minute run LRMS [M+Na=328]. Compound is a mixture of two rotamers ~1:1:

Rotamer 1: $^1$H NMR (METHANOL-d$_4$) δ: 5.22 (br. s., 1H), 4.19 (d, J=10.6 Hz, 1H), 4.00 (d, J=10.6 Hz, 1H), 3.90-3.95 (m, 2H), 3.77-3.82 (m, 2H), 3.67 (d, J=7.6 Hz, 1H), 2.94 (s, 3H), 1.47 (s, 9H)

Rotamer 2: $^1$H NMR (METHANOL-d$_4$) δ: 5.21 (br. s., 1H), 4.05-4.10 (m, 1H), 4.00 (d, J=10.6 Hz, 1H), 3.90-3.95 (m, 2H), 3.77-3.82 (m, 2H), 3.67 (d, J=7.6 Hz, 1H), 2.94 (s, 3H), 1.47 (s, 9H)

(1S,2R,3R,4R,5S)-1-(hydroxymethyl)-4-(methylamino)-6,8-dioxabicyclo[3.2.1]octane-2,3-diol hydrochloride (32)

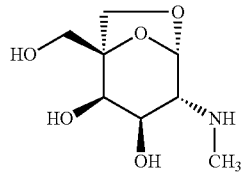

To a solution of tert-butyl [(1S,2R,3R,4R,5S)-2,3-dihydroxy-1-(hydroxymethyl)-6,8-dioxabicyclo[3.2.1]oct-4-yl]methylcarbamate (31) (25.3 mg, 0.0829 mmol) in dichloromethane (5.0 mL) was added 4.0M hydrogen chloride in dioxane (0.518 mL, 2.07 mmol) and the reaction was allowed to stir for 48 hours at room temperature. After 48 hours, the reaction was concentrated under reduced pressure. The crude material was washed with ethyl acetate (5 mL) which created a solid and diluted with heptane (10 mL) and concentrated under reduced pressure yielding the title compound as a solid (30.0 mg, 130%). Method C: 3 minute run LRMS [M+1=206]. $^1$H NMR (METHANOL-d$_4$) δ: 5.63 (s, 1H), 3.90-3.97 (m, 3H), 3.84 (s, 2H), 3.78 (d, J=8.2 Hz, 1H), 3.10-3.20 (m, 1H), 2.84 (s, 3H)

N-[(1S,2R,6R,7R,8S)-4,4-dimethyl-1-(15-phenyl-2,5,8,11,14-pentaoxapentadec-1-yl)-3,5,9,11-tetraoxatricyclo[6.2.1.0~2,6~]undec-7-yl]acetamide (I-e-3)

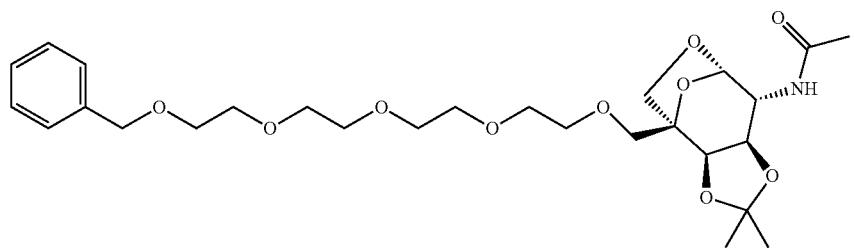 [SMILES: CC(=O)N[C@H]1[C@H]2OC[C@](COCCOCCOCCOCCOCc3ccccc3)(O2)[C@@H]2OC(C)(C)O[C@H]12]

To a solution of N-[(1S,2R,6R,7R,8S)-1-(hydroxymethyl)-4,4-dimethyl-3,5,9,11-tetraoxatricyclo[6.2.1.0~2,6~]undec-7-yl]acetamide (I-e-1) (1200 mg, 4.39 mmol) and 13-iodo-1-phenyl-2,5,8,11-tetraoxatridecane

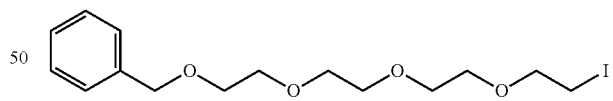

(see Synthetic Metals, 162(23), 2163-2170; 2012; 7000 mg, 17.76 mmol) in dichloromethane (30.0 mL) was added tetrabutylammonium hydrogen sulfate (2290 mg, 6.60 mmol) followed by the addition of 12.5M Sodium hydroxide aqueous (30.0 mL, 380 mmol). The reaction was allowed to stir at room temperature for 64 hours. After 64 hours, the reaction was diluted with water and dichloromethane. The layers were separated and the aqueous layer was extracted two additional times with dichloromethane. The combined organic layers were washed with 1N hydrochloric acid, dried over magnesium sulfate, filtered and concentrated under reduced pressure. The resulting crude material was added ethyl acetate (50 mL) and stirred for 30 minutes. The resulting precipitate was filtered. The filtrate was concentrated under reduced pressure.

The crude material was purified using the CombiFlash Rf (ISCO RediSep Gold 80 g silica gel column) and eluting with a gradient of 0-100% ethyl acetate/heptane immediately followed by eluting with a gradient of 0-20% methanol/dichloromethane yielding the title compound (1267 mg, 53.5%). Method C: 1.5 minute run LRMS [M+Na=562]. $^1$H NMR (METHANOL-$d_4$) δ: 7.13-7.45 (m, 5H), 5.22 (d, J=1.6 Hz, 1H), 4.55 (s, 2H), 4.30 (d, J=5.9 Hz, 1H), 4.15 (t, J=6.4 Hz, 1H), 3.89-3.97 (m, 2H), 3.85 (d, J=7.8 Hz, 1H), 3.73-3.79 (m, 2H), 3.58-3.71 (m, 16H), 1.98 (s, 3H), 1.48 (s, 3H), 1.33 (s, 3H)

N-[(1S,2R,3R,4R,5S)-2,3-dihydroxy-1-(15-phenyl-2,5,8,11,14-pentaoxapentadec-1-yl)-6,8-dioxabicyclo[3.2.1]oct-4-yl]acetamide (33)

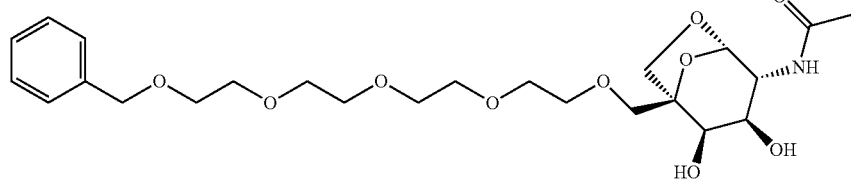

A solution of N-[(1S,2R,6R,7R,8S)-4,4-dimethyl-1-(15-phenyl-2,5,8,11,14-pentaoxapentadec-1-yl)-3,5,9,11-tetraoxatricyclo[6.2.1.0~2,6~]undec-7-yl]acetamide (I-e-3) (60.0 mg, 0.11 mmol) in acetic acid (4.0 mL), methanol (1.0 mL) and water (1.0 mL) was heated to 70° C. overnight. After 18 hours, the reaction was cooled to room temperature and concentrated under reduced pressure. The crude material was diluted with toluene and concentrated under reduced pressure. The crude material was diluted with toluene a second time and concentrated under reduced pressure. The crude material was purified using the CombiFlash Rf (RediSep 4 g Gold silica gel column) and eluting with a gradient of 0-20% methanol/dichloromethane yielding the title compound as a gum (42.5 mg, 77%). Method C: 3 minute run LRMS [M+1=500]. $^1$H NMR (METHANOL-$d_4$) δ: 7.14-7.45 (m, 5H), 5.21 (s, 1H), 4.55 (s, 2H), 3.92-4.01 (m, 2H), 3.88 (d, J=4.3 Hz, 1H), 3.77 (d, J=7.8 Hz, 1H), 3.70 (dd, J=9.8, 3.9 Hz, 1H), 3.58-3.68 (m, 18H), 1.98 (s, 3H)

N-[(1S,2R,6R,7R,8S)-1-(13-azido-2,5,8,11-tetraoxatridec-1-yl)-4,4-dimethyl-3,5,9,11-tetraoxatricyclo[6.2.1.0~2,6~]undec-7-yl]acetamide (I-e-2)

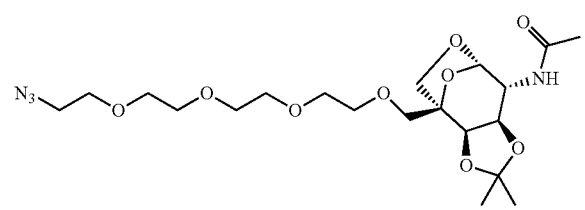 [SMILES: CC(=O)N[C@H]1[C@H]2OC[C@](COCCOCCOCCOCCN=[N+]=[N-])(O2)[C@@H]2OC(C)(C)O[C@H]12]

To a stirred solution of N-[(1S,2R,6R,7R,8S)-1-(hydroxymethyl)-4,4-dimethyl-3,5,9,11-tetraoxatricyclo[6.2.1.0~2,6~]undec-7-yl]acetamide (I-e-1) (10.0 g, 36.59 mmol, 1.0 eq) in N,N-dimethylformamide (200 ml) was added potassium hydroxide (8.21 g, 146.37 mmol, 4 eq) at 5° C. (ice/water). After addition, the reaction mixture was stirred at 5° C. for 30 min. Then 1-azido-2-{2-[2-(2-iodoethoxyl)ethoxy]ethoxy}ethane (36.13 g, 109.78 mmol, 3.0 eq) was added to the reaction mixture at 5° C. (ice/water). The reaction mixture was stirred at 5° C. (ice/water) for 30 minutes and the reaction mixture was heated to 27° C. and stirred at 27° C. for 18 hours. After 18 hours, the reaction mixture was poured into ice/water and extracted three times with dichloromethane (400 ml). The combined organic layers were washed three times with water (400 ml), brine (500 ml), dried over sodium sulfate, filtered and concentrated to give crude product. The crude product was purified by silica gel chromatography eluted with dichloromethane: methanol=100:1-40:1 to the title compound (10.0 g, 57.6%) as colorless oil. Method C: 3 minute run LRMS [M+45 (formic acid)=519]. $^1$H NMR (METHANOL-$d_4$) δ: 5.23 (d, J=2.0 Hz, 1H), 4.31 (d, J=5.9 Hz, 1H), 4.16 (t, J=6.6 Hz, 1H), 3.93-3.97 (m, 1H), 3.90-3.93 (m, J=2.0 Hz, 1H), 3.86 (d, J=7.8 Hz, 1H), 3.78 (d, J=3.9 Hz, 1H), 3.75 (d, J=1.6 Hz, 1H), 3.61-3.71 (m, 14H), 3.37 (t, J=4.9 Hz, 2H), 1.98 (s, 3H), 1.49 (s, 3H), 1.34 (s, 3H)

N-[(1S,2R,3R,4R,5S)-1-(13-azido-2,5,8,11-tetraoxatridec-1-yl)-2,3-dihydroxy-6,8-dioxabicyclo[3.2.1]oct-4-yl]acetamide (34)

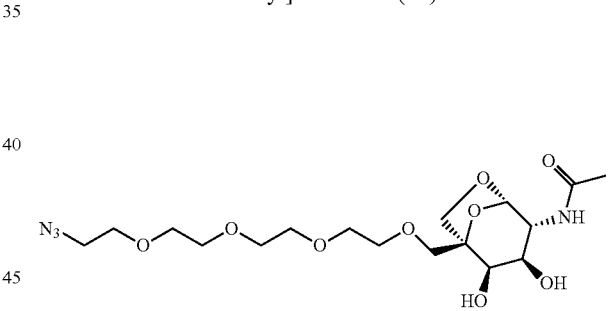

A solution of N-[(1S,2R,6R,7R,8S)-1-(13-azido-2,5,8,11-tetraoxatridec-1-yl)-4,4-dimethyl-3,5,9,11-tetraoxatricyclo[6.2.1.0~2,6~]undec-7-yl]acetamide (I-e-2) (82.0 mg, 0.17 mmol) in acetic acid (6.0 mL), methanol (1.45 mL) and water (1.45 mL) was heated to 70° C. overnight. After 18 hours, the reaction was cooled to room temperature and concentrated under reduced pressure. The crude material was diluted with toluene and concentrated under reduced pressure. The crude material was diluted with toluene a second time and concentrated under reduced pressure. The crude material was purified using the CombiFlash Rf (RediSep 4 g Gold silica gel column) and eluting with a gradient of 0-20% methanol/dichloromethane yielding the title compound as an oil (43.3 mg, 58%). Method C: 3 minute run LRMS [M−1=433]. $^1$H NMR (METHANOL-$d_4$) δ: 5.21 (d, J=0.8 Hz, 1H), 3.98 (d, J=9.8 Hz, 1H), 3.94 (d, J=9.8 Hz, 1H), 3.89 (d, J=4.3 Hz, 1H), 3.78 (d, J=7.8 Hz, 1H), 3.72 (dd, J=10.1, 4.3 Hz, 1H), 3.61-3.69 (m, 16H), 3.38 (t, J=4.9 Hz, 2H), 1.99 (s, 3H)

N-[(1S,2R,6R,7R,8S)-4,4-dimethyl-1-(2,5,8,11-tetraoxatetradec-13-en-1-yl)-3,5,9,11-tetraoxatricyclo[6.2.1.0~2,6~]undec-7-yl]acetamide (I-e-4)

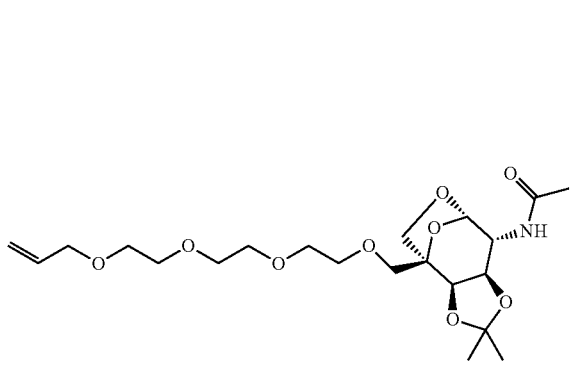 [SMILES: C=CCOCCOCCOCCOC[C@@]12CO[C@@H](O1)[C@H](NC(C)=O)[C@H]1OC(C)(C)O[C@H]12]

To a solution of N-[(1S,2R,6R,7R,8S)-1-(hydroxymethyl)-4,4-dimethyl-3,5,9,11-tetraoxatricyclo[6.2.1.0~2,6~]undec-7-yl]acetamide (I-e-1) (50.0 mg, 0.18 mmol) and 3-{2-[2-(2-iodoethoxy)ethoxy]ethoxy}prop-1-ene

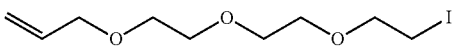

(see Organic Letters, 5(11), 1887-1890; 2003, 139.0 mg, 0.463 mmol) in dichloromethane (1.5 mL) was added tetrabutylammonium hydrogen sulfate (95.3 mg, 0.275 mmol) followed by the addition of 12.5M sodium hydroxide aqueous (0.75 mL, 9.4 mmol). The reaction was allowed to stir at room temperature overnight. After 18 hours, the reaction was diluted with water and dichloromethane. The layers were separated and the aqueous layer was extracted two additional times with dichloromethane. The combined organic layers were washed with 1N hydrochloric acid, water, dried over magnesium sulfate, filtered and concentrated under reduced pressure. The resulting crude material was diluted with ethyl acetate (5 mL) and the resulting precipitate was stirred at room temperature for 30 minutes. The precipitate was filtered and the filter cake was washed with ethyl acetate (2×5 mL). The filtrate was concentrated under reduced pressure. The crude material was purified using the CombiFlash Rf (ISCO RediSep Gold 4 g silica gel column) and eluting with a gradient of 0-100% ethyl acetate/heptane. The column was then eluted with a gradient of 0-20% methanol/dichloromethane yielding the title compound (13.6 mg, 17%). Method C: 1.5 minute run LRMS [M+Na=468]. $^1$H NMR (METHANOL-d$_4$) δ: 5.92 (ddt, J=16.8, 10.9, 5.7 Hz, 1H), 5.28 (dd, J=17.4, 1.4 Hz, 1H), 5.23 (d, J=1.6 Hz, 1H), 5.16 (dd, J=10.3, 1.0 Hz, 1H), 4.31 (d, J=5.9 Hz, 1H), 4.15 (t, J=6.4 Hz, 1H), 4.02 (d, J=5.5 Hz, 2H), 3.89-3.97 (m, 2H), 3.86 (d, J=7.8 Hz, 1H), 3.73-3.80 (m, 2H), 3.56-3.72 (m, 12H), 1.98 (s, 3H), 1.49 (s, 3H), 1.34 (s, 3H).

N-[(1S,2R,3R,4R,5S)-2,3-dihydroxy-1-(2,5,8,11-tetraoxatetradec-13-en-1-yl)-6,8-dioxabicyclo[3.2.1]oct-4-yl]acetamide (35)

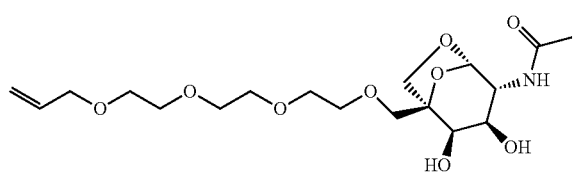 [SMILES: C=CCOCCOCCOCCOC[C@@]12CO[C@@H](O1)[C@H](NC(C)=O)[C@@H](O)[C@H]2O]

A solution of N-[(1S,2R,6R,7R,8S)-4,4-dimethyl-1-(2,5,8,11-tetraoxatetradec-13-en-1-yl)-3,5,9,11-tetraoxatricyclo[6.2.1.0~2,6~]undec-7-yl]acetamide (I-e-4) (13.0 mg, 0.029 mmol) in acetic acid (1.0 mL), methanol (0.25 mL) and water (0.25 mL) was heated to 70° C. overnight. After 18 hours, the reaction was cooled to room temperature and concentrated under reduced pressure. The crude material was diluted with toluene and concentrated under reduced pressure. The crude material was diluted with toluene a second time and concentrated under reduced pressure. The crude material was purified using the CombiFlash Rf (RediSep 4 g Gold silica gel column) and eluting with a gradient of 0-20% methanol/dichloromethane yielding the title compound (6.5 mg, 55%). Method C: 3 minute run LRMS [M+1=406]. $^1$H NMR (METHANOL-d$_4$) δ: 5.80-6.09 (m, 1H), 5.28 (dd, J=17.2, 1.6 Hz, 1H), 5.21 (d, J=0.8 Hz, 1H), 5.16 (dd, J=10.5, 1.2 Hz, 1H), 4.02 (d, J=5.5 Hz, 2H), 3.98 (d, J=9.8 Hz, 1H), 3.95 (d, J=10.1 Hz, 1H), 3.89 (d, J=3.9 Hz, 1H), 3.78 (d, J=8.2 Hz, 1H), 3.71 (dd, J=10.0, 4.5 Hz, 1H), 3.57-3.68 (m, 14H), 1.99 (s, 3H).

N-[(1S,2R,6R,7R,8S)-4,4-dimethyl-1-(2,5,8,11-tetraoxatetradec-13-yn-1-yl)-3,5,9,11-tetraoxatricyclo[6.2.1.0~2,6~]undec-7-yl]acetamide (I-e-5)

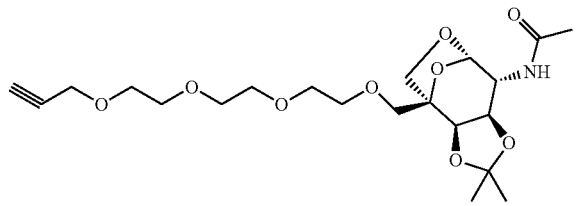 [SMILES: C#CCOCCOCCOCCOC[C@@]12CO[C@@H](O1)[C@H](NC(C)=O)[C@H]1OC(C)(C)O[C@H]12]

To a solution of N-[(1S,2R,6R,7R,8S)-4,4-dimethyl-1-(15-phenyl-2,5,8,11,14-pentaoxapentadec-1-yl)-3,5,9,11-tetraoxatricyclo[6.2.1.0~2,6~]undec-7-yl]acetamide (I-e-1) (100.0 mg, 0.366 mmol) and 3-{2-[2-(2-iodoethoxyl)ethoxy]ethoxy}prop-1-yne

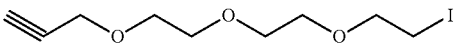

(see Synthesis, (10), 1639-1644; 2010, 425.0 mg, 1.43 mmol) in dichloromethane (3 mL) was added tetrabutylammonium hydrogen sulfate (191 mg, 0.550 mmol) followed by the addition of 12.5M sodium hydroxide aqueous (1.5 mL, 19 mmol). The reaction was allowed to stir at room temperature overnight. After 18 hours, the reaction was diluted with water and dichloromethane. The layers were separated and the aqueous layer was extracted two additional times with dichloromethane. The combined organic layers were washed with 1N hydrochloric acid, water, dried over magnesium sulfate, filtered and concentrated under reduced pressure. The resulting crude material was diluted with ethyl acetate (20 mL) and the resulting precipitate was stirred at room temperature for 30 minutes. The precipitate was filtered and the filter cake was washed with ethyl acetate (2×15 mL). The filtrate was concentrated under reduced pressure. The crude material was purified using the CombiFlash Rf (ISCO RediSep Gold 12 g silica gel column) and eluting with a gradient of 0-100% ethyl acetate/heptane. The column was then eluted with a gradient of 0-20% methanol/dichloromethane yielding the title compound (70.0 mg, 43%). Method C: 1.5 minute run LRMS [M+Na=466]. $^1$H NMR (METHANOL-$d_4$) δ: 5.23 (d, J=1.6 Hz, 1H), 4.31 (d, J=5.9 Hz, 1H), 4.19 (d, J=2.3 Hz, 2H), 4.16 (t, J=6.4 Hz, 1H), 3.90-3.97 (m, 2H), 3.86 (d, J=7.8 Hz, 1H), 3.74-3.79 (m, 2H), 3.60-3.72 (m, 12H), 2.85 (t, J=2.3 Hz, 1H), 1.98 (s, 3H), 1.49 (s, 3H), 1.34 (s, 3H)

N-[(1S,2R,3R,4R,5S)-2,3-dihydroxy-1-(2,5,8,11-tetraoxatetradec-13-yn-1-yl)-6,8-dioxabicyclo[3.2.1]oct-4-yl]acetamide (36)

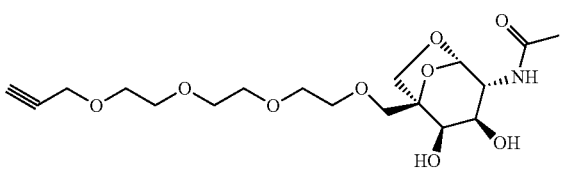 [SMILES: C#CCOCCOCCOCCOC[C@@]12CO[C@@H](O1)[C@H](NC(C)=O)[C@@H](O)[C@H]2O]

A solution of N-[(1S,2R,6R,7R,8S)-4,4-dimethyl-1-(2,5,8,11-tetraoxatetradec-13-yn-1-yl)-3,5,9,11-tetraoxatricyclo[6.2.1.0~2,6~]undec-7-yl]acetamide (I-e-5) (70.0 mg, 0.16 mmol) in acetic acid (4.0 mL), methanol (1.0 mL), and water (1.0 mL) was heated to 70° C. overnight. After 18 hours, the reaction was cooled to room temperature and concentrated under reduced pressure. The crude material was diluted with toluene and concentrated under reduced pressure. The crude material was diluted with toluene a second time and concentrated under reduced pressure. The crude material was purified using the CombiFlash Rf (RediSep 4 g Gold silica gel column) and eluting with a gradient of 0-20% methanol/dichloromethane yielding the title compound as a gum (57.6 mg, 90%). Method C: 3 minute run LRMS [M+1=404]. $^1$H NMR (METHANOL-$d_4$) δ: 5.22 (s, 1H), 4.19 (d, J=1.8 Hz, 2H), 3.98 (d, J=10.0 Hz, 1H), 3.94 (d, J=10.0 Hz, 1H), 3.89 (d, J=4.1 Hz, 1H), 3.78 (d, J=8.2 Hz, 1H), 3.71 (dd, J=10.0, 4.1 Hz, 1H), 3.60-3.69 (m, 14H), 2.86 (s, 1H), 1.99 (s, 3H)

N-[(1S,2R,3R,4R,5S)-1-(13-amino-2,5,8,11-tetraoxatridec-1-yl)-2,3-dihydroxy-6,8-dioxabicyclo[3.2.1]oct-4-yl]acetamide (37)

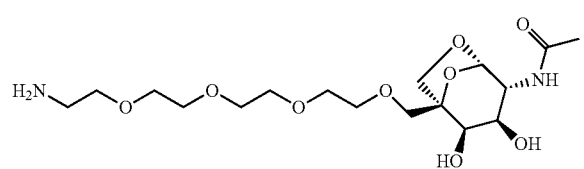 [SMILES: CC(=O)N[C@H]1[C@H]2OC[C@](COCCOCCOCCOCCN)(O2)[C@H](O)[C@@H]1O]

A solution of N-[(1S,2R,3R,4R,5S)-1-(13-azido-2,5,8,11-tetraoxatridec-1-yl)-2,3-dihydroxy-6,8-dioxabicyclo[3.2.1]oct-4-yl]acetamide (34) (40.0 mg, 0.092 mmol) in ethanol (2 mL) was passed through the H-cube (conditions: catalyst (10% palladium on carbon (30×4 mm), flow rate: 1 mL/min., temperature: room temperature, pressure=Full $H_2$). After passing through the H-cube, the solution was collected and concentrated under reduced pressure yielding the title compound as a gum (17.2 mg, 46%). Method C: 3 minute run LRMS [M+1=409]. $^1$H NMR (METHANOL-$d_4$) δ: 5.21 (s, 1H), 3.92-4.00 (m, 2H), 3.89 (d, J=3.9 Hz, 1H), 3.78 (d, J=8.2 Hz, 1H), 3.69-3.74 (m, 1H), 3.61-3.69 (m, 14H), 3.56 (t, J=5.1 Hz, 2H), 2.85 (t, J=5.1 Hz, 2H), 1.99 (s, 3H)

N-[(1S,2R,3R,4R,5S)-2,3-dihydroxy-1-(13-hydroxy-2,5,8,11-tetraoxatridec-1-yl)-6,8-dioxabicyclo[3.2.1]oct-4-yl]acetamide (38)

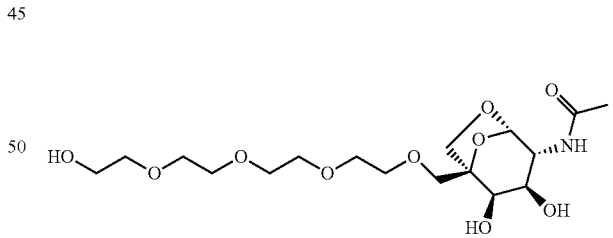

N-[(1S,2R,3R,4R,5S)-2,3-dihydroxy-1-(15-phenyl-2,5,8,11,14-pentaoxapentadec-1-yl)-6,8-dioxabicyclo[3.2.1]oct-4-yl]acetamide (33) (43 mg, 0.086 mmol) was dissolved in methanol (2 mL) was passed through the H-cube (conditions: catalyst (20% palladium hydroxide carbon (30×4 mm), flow rate: 1 mL/min., temperature: 600, pressure=Full $H_2$). After passing through the H-cube, the solution was collected and concentrated under reduced pressure yielding the title compound (32.2 mg, 91%). $^1$H NMR (METHANOL-$d_4$) δ: 5.21 (s, 1H), 3.98 (d, J=9.4 Hz, 1H), 3.95 (d, J=10.1 Hz, 1H), 3.89 (d, J=4.3 Hz, 1H), 3.78 (d, J=8.2 Hz, 1H), 3.71 (dd, J=9.8, 4.3 Hz, 1H), 3.61-3.69 (m, 16H), 3.54-3.59 (m, 2H), 1.99 (s, 3H).

$^{13}$C NMR (METHANOL-d$_4$) δ: 174.1, 102.6, 84.3, 73.8, 72.5, 71.7, 71.7(2), 71.6, 71.5, 71.4, 70.5, 70.2, 69.0, 62.4, 56.4, 22.7

N-[(1S,2R,6R,7R,8S)-1-(13-hydroxy-2,5,8,11-tetraoxatridec-1-yl)-4,4-dimethyl-3,5,9,11-tetraoxatricyclo[6.2.1.0~2,6~]undec-7-yl]acetamide (I-e-6)

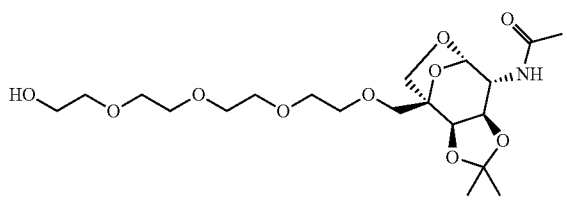 [SMILES: CC(=O)N[C@H]1[C@H]2OC[C@](COCCOCCOCCOCCO)(O2)[C@@H]2OC(C)(C)O[C@H]12]

N-[(1S,2R,6R,7R,8S)-4,4-dimethyl-1-(15-phenyl-2,5,8,11,14-pentaoxapentadec-1-yl)-3,5,9,11-tetraoxatricyclo[6.2.1.0~2,6~]undec-7-yl]acetamide (I-e-3) (2.897 g, 5.37 mmol) was dissolved in methanol (150 mL) was passed through the H-cube (conditions: catalyst (10% palladium on carbon (30×4 mm), flow rate: 1 mL/min., temperature: 60° C., pressure=Full H$_2$). After passing through the H-cube, the solution was collected and concentrated under reduced pressure yielding the title compound as a gum (2.5 g, 100%). Method C: 1.5 minute run LRMS [M+1=450]. $^1$H NMR (METHANOL-d$_4$) δ: 5.23 (d, J=1.6 Hz, 1H), 4.31 (d, J=5.9 Hz, 1H), 4.16 (t, J=6.4 Hz, 1H), 3.89-3.97 (m, 2H), 3.86 (d, J=7.8 Hz, 1H), 3.74-3.80 (m, 2H), 3.60-3.71 (m, 14H), 3.53-3.59 (m, 2H), 1.98 (s, 3H), 1.49 (s, 3H), 1.34 (s, 3H)

N-[(1S,2R,6R,7R,8S)-4,4-dimethyl-1-(13-oxo-2,5,8,11-tetraoxatridec-1-yl)-3,5,9,11-tetraoxatricyclo[6.2.1.0~2,6~]undec-7-yl]acetamide (I-e-6a)

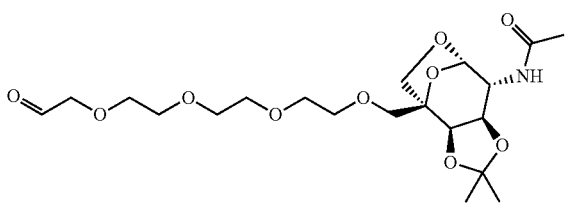 [SMILES: CC(=O)N[C@H]1[C@H]2OC[C@](COCCOCCOCCOCC=O)(O2)[C@@H]2OC(C)(C)O[C@H]12]

To a solution of N-[(1S,2R,6R,7R,8S)-1-(13-hydroxy-2,5,8,11-tetraoxatridec-1-yl)-4,4-dimethyl-3,5,9,11-tetraoxatricyclo[6.2.1.0~2,6~]undec-7-yl]acetamide (I-e-6) (175 mg, 0.389 mmol) in dichloromethane (5.0 mL) was added Dess-Martin reagent (354 mg, 0.584 mmol) which resulted in a mixture. After ~30 minutes, the reaction became almost homogeneous. After 3 hours, the reaction mixture was diluted with dichloromethane and filtered through a plug of celite and washed with dichloromethane. The filtrate was concentrated under reduced pressure. The crude material was purified using the CombiFlash Rf (RediSep 24 g gold silica gel column) and eluting with a gradient of 0-20% methanol/dichloromethane. The tubes containing the desired product were concentrated under reduced pressure. The resulting material was diluted with dichloromethane (4 mL) and diluted with ethyl ether (10 mL) which resulted in a white precipitate. The solution was decanted and the solid was diluted with dichloromethane (2 mL) and ethyl ether (8 mL) and decanted a second time. The decanted solution was passed through a Life Science Acrodisc 25 mm syringe filter with 0.45 um Nylon membrane. The collected solution was concentrated under reduced pressure yielding the title compound as a gum (65.0 mg, 37%). Method C: 3 minute run LRMS [M+1=448]. $^1$H NMR (CHLOROFORM-d) δ: 9.74 (s, 1H), 5.63 (d, J=9.0 Hz, 1H), 5.34 (d, J=1.6 Hz, 1H), 4.23 (d, J=5.9 Hz, 1H), 4.17 (s, 2H), 4.09-4.15 (m, 1H), 4.01 (t, J=6.2 Hz, 1H), 3.97 (d, J=10.1 Hz, 1H), 3.77-3.85 (m, 3H), 3.68-3.76 (m, 5H), 3.61-3.68 (m, 7H), 2.03 (s, 3H), 1.56 (s, 3H), 1.36 (s, 3H).

1-[(1S,2R,3R,4R,5S)-4-(acetylamino)-2,3-dihydroxy-6,8-dioxabicyclo[3.2.1]oct-1-yl]-2,5,8,11-tetraoxatridecan-13-oic acid (38A)

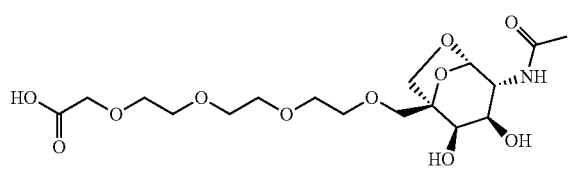 [SMILES: CC(=O)N[C@H]1[C@H]2OC[C@](COCCOCCOCCOCC(=O)O)(O2)[C@H](O)[C@@H]1O]

To a solution of N-[(1S,2R,6R,7R,8S)-4,4-dimethyl-1-(13-oxo-2,5,8,11-tetraoxatridec-1-yl)-3,5,9,11-tetraoxatricyclo[6.2.1.0~2,6~]undec-7-yl]acetamide (I-e-6a) (60.0 mg, 0.13 mmol) in tetrahydrofuran/t-butanol (1.5 mL/1.5 mL) was treated with 2-methyl-2-butene (1.0 mL) followed by a solution of sodium chlorite (169.4 mg, 2.01 mmol) and sodium phosphate (250.0 mg, 2.58 mmol) (monobasic and monohydrate, 250 mg, 2.58 mmol) in water (1.5 mL) via glass pipet. The reaction was allowed to stir at room temperature for 24 hours. After 24 hours, the reaction mixture was poured into water and extracted with ethyl acetate (three times). The organic layer was discarded. The aqueous layers were concentrated under reduced pressure and the resulting crude was dissolved in methanol (10 mL) and dichloromethane (100 mL) and the resulting mixture was filtered. The filtrate was concentrated under reduced pressure. The resulting material was dissolved in methanol (5 mL) and dichloromethane (50 mL) and the resulting mixture was filtered. The filtrate was purified using the CombiFlash Rf (RediSep 4 g silica gel column) and eluting with a gradient of 0-100% methanol/dichloromethane yielding the title compound as a gum as a sodium salt (40 mg, None, 67%). LRMS [M+1=424]; $^1$H NMR (METHANOL-d$_4$) δ: 5.24 (s, 1H), 4.14 (s, 2H), 3.97 (d, J=10.1 Hz, 2H), 3.90 (d, J=3.9 Hz, 1H), 3.81 (d, J=7.8 Hz, 1H), 3.63-3.77 (m, 15H), 2.01 (s, 3H)

1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl methanesulfonate (I-e-7)

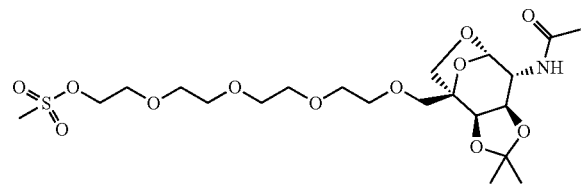 [SMILES: CC(=O)N[C@H]1[C@H]2OC[C@](COCCOCCOCCOCCOS(C)(=O)=O)(O2)[C@@H]2OC(C)(C)O[C@H]12]

To a solution of 1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl methanesulfonate (I-e-6) (1117 mg, 2.49 mmol) in dichloromethane (12.4 mL) was added triethylamine (1.05 mL, 7.45 mmol) and cooled to 0° C. using an ice bath followed by the addition of methane sulfonyl chloride (0.232 mL, 2.98 mmol). The reaction was allowed to warm slowly to room temperature and stirred at room temperature for 1.5 hours. After 1.5 hours, the reaction was quenched with water and extracted. The layers were separated and the aqueous layer was extracted an additional time with dichloromethane. The combined organic layers were washed with brine, dried over magnesium sulfate, filtered and concentrated under reduced pressure yielding the title compound which was carried on crude (1300.0 mg, 99.2%). Method C: 3 minute run LRMS [M+Na=550]. $^1$H NMR (METHANOL-$d_4$) δ: 5.23 (d, J=2.0 Hz, 1H), 4.34-4.40 (m, 2H), 4.31 (d, J=5.9 Hz, 1H), 4.15 (t, J=6.4 Hz, 1H), 3.89-3.97 (m, 2H), 3.86 (d, J=7.8 Hz, 1H), 3.72-3.81 (m, 4H), 3.59-3.71 (m, 12H), 3.11 (s, 3H), 1.98 (s, 3H), 1.48 (s, 3H), 1.34 (s, 3H)

S-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}ethanethioate (I-e-8)

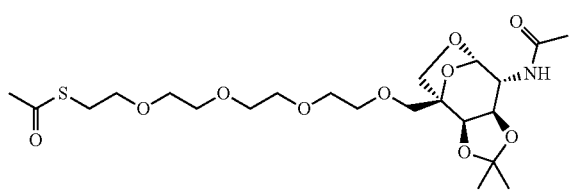 [SMILES: CC(=O)N[C@H]1[C@H]2OC[C@](COCCOCCOCCOCCSC(C)=O)(O2)[C@@H]2OC(C)(C)O[C@H]12]

To a solution of 1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl methanesulfonate (I-e-7) (125.0 mg, 0.237 mmol) in N,N-dimethylformamide (2 mL) was added potassium thioacetate (135 mg, 1.18 mmol) and the reaction was stirred at room temperature for 64 hours. After 64 hours, the reaction was diluted with water and extracted with ethyl acetate three times. The combined organic layers washed with brine, dried over sodium sulfate, filtered and concentrated under reduced pressure. The crude material was purified using the CombiFlash Rf (RediSep 4 g silica gel column) and eluting with a gradient of 0-20% methanol/dichloromethane yielding the title compound as a gum (95.2 mg, 79.2%). Method C: 3 minute run LRMS [M+Na=530]. $^1$H NMR (METHANOL-$d_4$) δ: 5.23 (d, J=1.6 Hz, 1H), 4.31 (d, J=5.9 Hz, 1H), 4.16 (t, J=6.4 Hz, 1H), 3.90-3.97 (m, 2H), 3.86 (d, J=7.8 Hz, 1H), 3.74-3.79 (m, 2H), 3.55-3.72 (m, 14H), 3.08 (t, J=6.6 Hz, 2H), 2.32 (s, 3H), 1.98 (s, 3H), 1.49 (s, 3H), 1.34 (s, 3H)

S-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}ethanethioate (39)

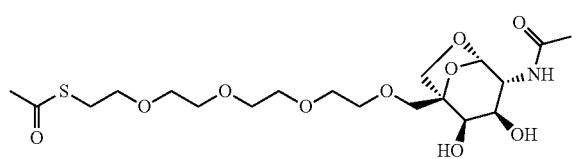 [SMILES: CC(=O)N[C@H]1[C@H]2OC[C@](COCCOCCOCCOCCSC(C)=O)(O2)[C@H](O)[C@@H]1O]

A solution of S-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}ethanethioate (I-e-8) (81.0 mg, 0.16 mmol) in acetic acid (6.0 mL), methanol (1.45 mL) and water (1.45 mL) was heated to 70° C. overnight. After 18 hours, the reaction was cooled to room temperature and concentrated under reduced pressure. The crude material was diluted with toluene and concentrated under reduced pressure. The crude material was diluted with toluene a second time and concentrated under reduced pressure. The crude material was purified using the CombiFlash Rf (RediSep 4 g Gold silica gel column) and eluting with a gradient of 0-20% methanol/dichloromethane yielding the title compound as a gum (53.7 mg, 72%). Method C: 3 minute run LRMS [M+1=468]. $^1$H NMR (METHANOL-$d_4$) δ: 5.23 (s, 1H), 4.00 (d, J=9.8 Hz, 1H), 3.97 (d, J=9.8 Hz, 1H), 3.91 (d, J=4.3 Hz, 1H), 3.80 (d, J=7.8 Hz, 1H), 3.73 (dd, J=10.1, 4.3 Hz, 1H), 3.63-3.70 (m, 14H), 3.60 (t, J=6.6 Hz, 2H), 3.10 (t, J=6.4 Hz, 2H), 2.34 (s, 3H), 2.01 (s, 3H)

N-{(1S,2R,3R,4R,5S)-2,3-dihydroxy-1-[13-(pyridin-2-yldisulfanyl)-2,5,8,11-tetraoxatridec-1-yl]-6,8-dioxabicyclo[3.2.1]oct-4-yl}acetamide (40)

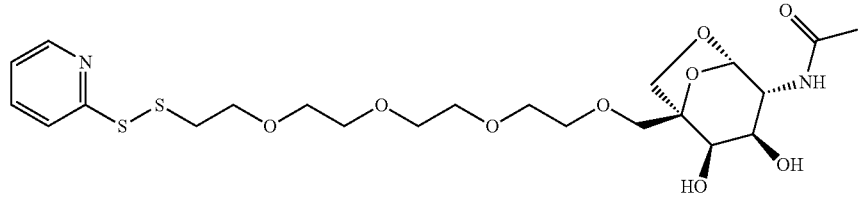 [SMILES: CC(=O)N[C@H]1[C@H]2OC[C@](COCCOCCOCCOCCSSc3ccccn3)(O2)[C@H](O)[C@@H]1O]

To a solution of S-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}ethanethioate (39) (50 mg, 0.11 mmol) in methanol (3 mL) followed by the addition of a 0.5M sodium methoxide solution in methanol (1.28 mL, 0.642 mmol) and the reaction was allowed to stir for 45 minutes at room temperature. After 45 minutes, acetic acid (42 mg, 0.70 mmol, 0.040 mL) was added and stirred for 10 minutes. The methanol solution was then added drop wise to a stirring solution of 2,2'-disulfanediyldipyridine (35.3 mg, 0.160 mmol) in a mixture of methanol (2 mL) and acetic acid (1 mL). The reaction was allowed to stir for 2 hours at room temperature. After 2 hours, the reaction was concentrated under reduced pressure. The crude material was purified using the CombiFlash Rf (RediSep Gold 4 g silica gel column) and eluting with a gradient of 0-20% methanol/dichloromethane yielding the title compound (31.4 mg, 55%). Method C: 3 minute run LRMS [M+Na=557]. $^1$H NMR (METHANOL-d$_4$) δ: 8.39 (d, J=4.3 Hz, 1H), 7.94 (d, J=8.2 Hz, 1H), 7.83 (td, J=7.8, 1.6 Hz, 1H), 7.22 (dd, J=6.8, 5.3 Hz, 1H), 5.21 (s, 1H), 3.92-4.00 (m, 2H), 3.88 (d, J=4.3 Hz, 1H), 3.77 (d, J=7.8 Hz, 1H), 3.71 (t, J=6.0 Hz, 3H), 3.59-3.67 (m, 12H), 3.52-3.58 (m, 2H), 3.02 (t, J=6.0 Hz, 2H), 1.99 (s, 3H)

tert-butyl {1,3-bis(prop-2-yn-1-yloxy)-2-[(prop-2-yn-1-yloxy)methyl]propan-2-yl}carbamate (I-f-3)

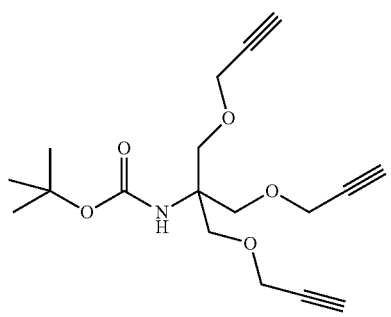 [SMILES: C#CCOCC(COCC#C)(COCC#C)NC(=O)OC(C)(C)C]

See Journal of Organic Chemistry, 73(14), 5602-5605; 2008 for synthesis of (I-f-3). 1,3-bis(prop-2-yn-1-yloxy)-2-[(prop-2-yn-1-yloxy)methyl]propan-2-amine hydrochloric acid (I-p-1)

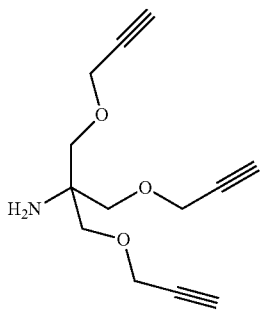 [SMILES: C#CCOCC(N)(COCC#C)COCC#C]

To a solution of tert-butyl {1,3-bis(prop-2-yn-1-yloxy)-2-[(prop-2-yn-1-yloxy)methyl]propan-2-yl}carbamate (I-f-3) (3000 mg, 8.945 mmol) in dichloromethane (45 mL) was added 4.0M hydrogen chloride in dioxane (20 mL, 89.4 mmol) and the reaction was stirred for 18 hours at room temperature. After 18 hours, the reaction was concentrated under reduced pressure yielding of an oil. Ethyl acetate (20 mL) was added to the crude mixture and the resulting mixture was stirred. Heptane (20 mL) was added and the mixture was stirred for 2 hours at room temperature. The material was filtered and the filter cake was washed with ethyl acetate and dried by pulling vacuum for 2 hours yielding the title compound (2140 mg, 88%). $^1$H NMR (METHANOL-d$_4$) δ: 4.25 (s, 6H), 3.72 (s, 6H), 2.97 (s, 3H).

benzyl [6-({1,3-bis(prop-2-yn-1-yloxy)-2-[(prop-2-yn-1-yloxy)methyl]propan-2-yl}amino)-6-oxohexyl]carbamate (I-q-1)

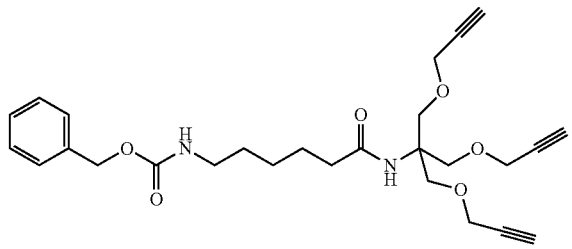 [SMILES: C#CCOCC(COCC#C)(COCC#C)NC(=O)CCCCCNC(=O)OCc1ccccc1]

To a solution of 6-{[(benzyloxy)carbonyl]amino}hexanoic acid (2910 mg, 11.0 mmol) in N,N-dimethylformamide (4 mL) and tetrahydrofuran (20.0 mL) was added N-(3-dimethylaminopropyl)-N'-ethylcarbodimiimide hydrochloride (I-p-1) (2150 mg, 11.0 mmol) and 1-hydroxybenzotriazole (1480 mg, 11.0 mmol) and the reaction was allowed to stir at room temperature for 1 hour during which time the reaction became homogeneous. 1,3-bis(prop-2-yn-1-yloxy)-2-[(prop-2-yn-1-yloxy)methyl]propan-2-amine hydrochloric acid (2130 mg, 7.84 mmol) was added neat in one portion to the stirring reaction mixture followed by the addition of N,N-diisopropylethylamine (5.46 mL, 31.4 mmol) and the reaction was heated to 60° C. for 24 hours. The reaction was allowed to cool to room temperature and was stirred for 24 hours. The reaction was quenched with water (150 mL) and extracted with ethyl acetate. The aqueous layer was washed an additional time with ethyl acetate. The combined organic layers were washed with brine, dried over sodium sulfate, filtered and concentrated under reduced pressure. The crude material was purified using the CombiFlash Rf (RediSep 80 g silica gel column) and eluting with a gradient of 0-100% ethyl acetate/heptane yielding the title compound as an oil which solidified upon standing (3250 mg, 86%). Method C: MassLynx\Acid_3.0 Min.olp-LRMS [M+1=483]. $^1$H NMR (METHANOL-d$_4$) δ: 7.10-7.46 (m, 5H), 5.06 (s, 2H), 4.14 (d, J=2.0 Hz, 6H), 3.79 (s, 6H), 3.03-3.20 (m, 2H), 2.83 (t, J=2.1

Hz, 3H), 2.18 (t, J=7.2 Hz, 2H), 1.59 (quin, J=7.3 Hz, 2H), 1.44-1.54 (m, 2H), 1.28-1.40 (m, 2H)

6-(pyridin-2-yldisulfanyl)hexanoic acid (I-r-1)

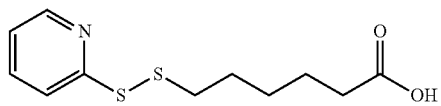 [SMILES: O=C(O)CCCCCSSc1ccccn1]

To a solution of 2,2'-disulfanediyldipyridine

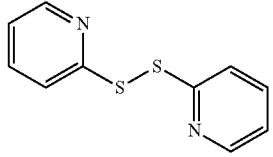 [SMILES: c1ccc(SSc2ccccn2)nc1]

(1490 mg, 6.75 mmol) in a mixture of ethanol (12.0 mL) and acetic acid (0.291 mL) was stirred under nitrogen followed by the drop wise addition of 6-sulfanylhexanoic acid

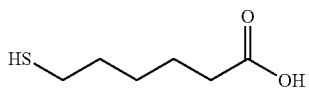

(1000.0 mg, 6.75 mmol) in ethyl acetate (6.0 mL). The reaction was allowed to stir for 2 hours at room temperature. After 2 hours, the reaction was concentrated under reduced pressure. The crude material was purified using the CombiFlash Rf (RediSep Gold 40 g silica gel column) and eluting with a gradient of 0-100% ethyl acetate (2% acetic acid modifier)/heptane yielding crude title compound (1170 mg). The crude material was purified again using the CombiFlash Rf (RediSep Gold 40 g silica gel column) and eluting with a gradient of 0-100% ethyl acetate (2% acetic acid modifier)/heptane yielding the title compound as an oil (544 mg, 31%).

1-{[6-(pyridin-2-yldisulfanyl)hexanoyl]oxy}pyrrolidine-2,5-dione (I-s-1)

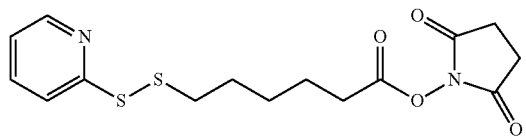 [SMILES: O=C(CCCCCSSc1ccccn1)ON1C(=O)CCC1=O]

To a solution of 6-(pyridin-2-yldisulfanyl)hexanoic acid (I-r-1) (705 mg, 2.2 mmol) in N,N-dimethylformamide (4 mL) was added N-Hydroxysuccinimide (306 mg, 2.66 mmol) followed by N-(3-dimethylaminopropyl)-N'-ethylcarbodimiimide hydrochloride (520 mg, 2.66 mmol). The reaction was allowed to stir at room temperature overnight. The following morning, the reaction was quenched with water and extracted three times with dichloromethane. The combined organic layers were washed with saturated sodium bicarbonate, brine, dried over sodium sulfate, filtered and concentrated under reduced pressure. The crude material was purified using the CombiFlash Rf (RediSep 40 g gold column) and eluting with a gradient of 0-100% ethyl acetate/heptane yielding the title compound (364 mg, 47%). Method C: 1.5 minute run LRMS [M+1=355]. $^1$H NMR (METHANOL-$d_4$) δ: 8.39 (d, J=4.7 Hz, 1H), 7.85-7.90 (m, 1H), 7.77-7.84 (m, 1H), 7.21 (dd, J=6.6, 5.5 Hz, 1H), 2.77-2.90 (m, 6H), 2.61 (t, J=7.2 Hz, 2H), 1.63-1.83 (m, 4H), 1.46-1.59 (m, 2H)

N-{1,3-bis(prop-2-yn-1-yloxy)-2-[(prop-2-yn-1-yloxy)methyl]propan-2-yl}-6-(pyridin-2-yldisulfanyl)hexanamide (I-t-1)

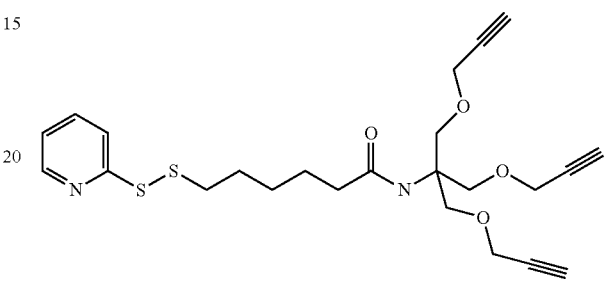

To a solution of 1,3-bis(prop-2-yn-1-yloxy)-2-[(prop-2-yn-1-yloxy)methyl]propan-2-amine hydrochloric acid (I-p-1) (100.0 mg, 0.324 mmol) in N,N-dimethylformamide (2.0 mL) was added N,N-diisopropylethylamine (0.339 mL, 1.95 mmol) and was allowed to stir for 10 minutes before adding 1-{[6-(pyridin-2-yldisulfanyl)hexanoyl]oxy}pyrrolidine-2,5-dione (I-s-1) (138 mg, 0.389 mmol) in one portion and the reaction was then heated to 60° C. for 16 hours. After 16 hours, the reaction was diluted with water and extracted with three times with ethyl acetate. The combined organic layers were washed with water, brine, dried over sodium sulfate, filtered and concentrated under reduced pressure. The crude material was purified using the CombiFlash Rf (RediSep 12 g silica gel column) and eluting with a gradient of 0-100% ethyl acetate/heptane yielding the title compound as a gum (66.7 mg, 43%). Method C: 1.5 minute run LRMS [M+Na=497]. $^1$H NMR (METHANOL-$d_4$) δ: 8.39 (d, J=4.7 Hz, 1H), 7.85-7.90 (m, 1H), 7.78-7.84 (m, 1H), 7.19-7.25 (m, 1H), 4.06-4.23 (m, 6H), 3.72-3.84 (m, 6H), 2.78-2.87 (m, 5H), 2.12-2.20 (m, 2H), 1.71 (quin, J=7.3 Hz, 2H), 1.57 (quin, J=7.3 Hz, 2H), 1.36-1.50 (m, 2H)

1-{[4-(benzyloxy)butanoyl]oxy}pyrrolidine-2,5-dione (I-u-1)

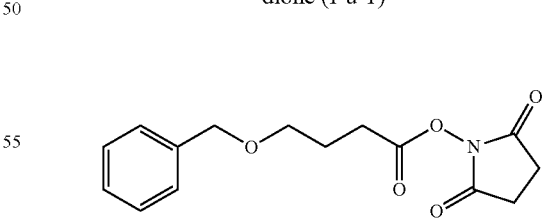

To a solution of 4-(Benzyloxy)butanoic acid (1000 mg, 3.77 mmol) in N,N-dimethylformamide (7.54 mL) was added N-Hydroxysuccinimide (521 mg, 4.52 mmol) followed by N-(3-dimethylaminopropyl)-N'-ethylcarbodimiimide hydrochloride (885 mg, 4.52 mmol). The reaction was allowed to stir at room temperature overnight. The following morning, the reaction was quenched with water and extracted three times with dichloromethane. The combined organic layers were washed with saturated sodium bicarbonate, brine, dried over sodium sulfate, filtered and concentrated under reduced pressure. The crude material was purified using the CombiFlash Rf (RediSep 40 g gold column) and eluting with a gradient of 0-100% ethyl acetate/heptane yielding the title compound (1098 mg, 100%). Method C: 1.5 minute run LRMS [M+Na=314]. $^1$H NMR (METHANOL-$d_4$) δ: 7.11-7.50 (m, 5H), 4.51 (s, 2H), 3.56 (t, J=6.0 Hz, 2H), 2.81 (s, 4H), 2.73 (t, J=7.2 Hz, 2H), 1.99 (quin, J=6.6 Hz, 2H)

4-(benzyloxy)-N-{1,3-bis(prop-2-yn-1-yloxy)-2-[(prop-2-yn-1-yloxy)methyl]propan-2-yl}butanamide (I-v-1)

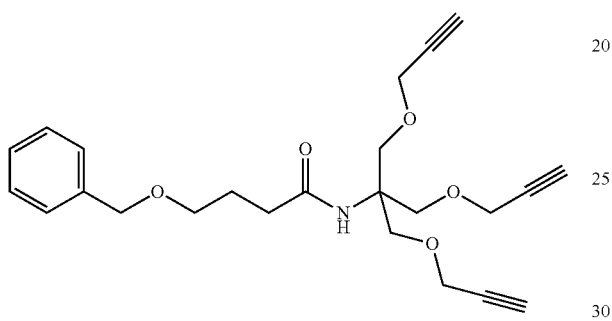

To a solution of 1,3-bis(prop-2-yn-1-yloxy)-2-[(prop-2-yn-1-yloxy)methyl]propan-2-amine trifluoroacetic acid (I-p-1) (750.0 mg, 1.62 mmol) in N,N-dimethylformamide (5 mL) was added N,N-diisopropylethylamine (1.69 mL, 9.71 mmol) and was allowed to stir for 10 minutes before the addition of 1-{[4-(benzyloxy)butanoyl]oxy}pyrrolidine-2,5-dione (I-u-1) (566 mg, 1.94 mmol) in N,N-dimethylformamide (1 mL) and the reaction was then heated to 60° C. for 72 hours. After 72 hours, the reaction was diluted with water and extracted with three times with ethyl acetate. The combined organic layers were washed with water, brine, dried over sodium sulfate, filtered and concentrated under reduced pressure. The crude material was purified using the CombiFlash Rf (RediSep 24 g silica gel column) and eluting with a gradient of 0-100% ethyl acetate/heptane yielding the title compound as a gum (495 mg, None, 74%). Method C: 1.5 minute run LRMS [M+1=412]. $^1$H NMR (METHANOL-$d_4$) δ: 7.21-7.41 (m, 5H), 4.51 (s, 2H), 4.12 (d, J=2.3 Hz, 6H), 3.78 (s, 6H), 3.51 (t, J=6.2 Hz, 2H), 2.82 (t, J=2.3 Hz, 3H), 2.28 (t, J=7.2 Hz, 2H), 1.79-1.94 (m, 2H)

tert-butyl (1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)carbamate (I-w-1)

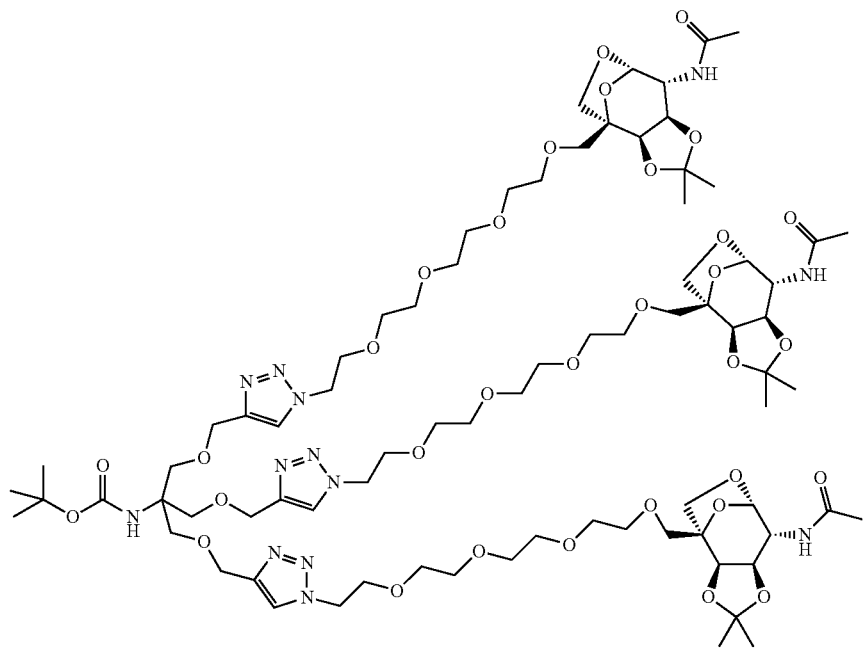 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)OC(C)(C)C)nn3)(O2)[C@@H]2OC(C)(C)O[C@H]12]

A 50 mL round bottom flask equipped with stir bar was charged with tert-butyl {1,3-bis(prop-2-yn-1-yloxy)-2-[(prop-2-yn-1-yloxy)methyl]propan-2-yl}carbamate (I-f-3) (305.0 mg, 0.909 mmol) was added N-[(1 S,2R,6R,7R,8S)-1-(13-azido-2,5,8,11-tetraoxatridec-1-yl)-4,4-dimethyl-3,5,9,11-tetraoxatricyclo[6.2.1.0~2,6~]undec-7-yl]acetamide (I-e-2) (1433.0 mg, 3.020 mmol) in t-butanol (12 mL) followed by the addition of water (5 mL) followed by the addition of sodium ascorbate (1840 mg, 9.09 mmol) neat and the reaction was purged with nitrogen for 10 minutes. Copper (II) sulfate (147 mg, 0.909 mmol) was added in 1 mL of water (deionized) and stirred at room temperature for 24 hours. After 24 hours, the reaction was quenched by adding the reaction mixture to a saturated ammonium chloride (30 mL) and conc. ammonium hydroxide (3 mL) and extracted three times with dichloromethane (20 mL). The combined organic layers were dried over magnesium sulfate, filtered and concentrated under reduced pressure. The crude material was purified using the CombiFlash Rf (RediSep 80 g gold silica gel column) and eluting with a gradient of 0-20% methanol/dichloromethane yielding the title compound as a white foam (789.0 mg, None, 49.3%). Method C: 1.5 minute run LRMS [M+45−1=1804]. $^1$H NMR (METHANOL-d$_4$) δ: 8.00 (s, 3H), 5.23 (d, J=1.6 Hz, 3H), 4.51-4.63 (m, 12H), 4.29 (d, J=5.9 Hz, 3H), 4.16 (t, J=6.4 Hz, 3H), 3.87-3.96 (m, 12H), 3.84 (d, J=7.8 Hz, 3H), 3.73-3.80 (m, 6H), 3.64-3.72 (m, 12H), 3.54-3.63 (m, 30H), 1.98 (s, 9H), 1.48 (s, 9H), 1.40 (s, 9H), 1.33 (s, 9H)

N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)-6-(pyridin-2-yldisulfanyl)hexanamide (I-x-1)

To a solution of N-{1,3-bis(prop-2-yn-1-yloxy)-2-[(prop-2-yn-1-yloxy)methyl]propan-2-yl}-6-(pyridin-2-yldisulfanyl)hexanamide (I-t-1) (66.0 mg, 0.14 mmol) and N-[(1 S,2R,6R,7R,8S)-1-(13-azido-2,5,8,11-tetraoxatridec-1-yl)-4,4-dimethyl-3,5,9,11-tetraoxatricyclo[6.2.1.0~2,6~]undec-7-yl]acetamide (I-e-2) (219 mg, 0.459 mmol) in t-butanol (2 mL) was added water (0.5 mL, deionized water). Sodium ascorbate (84.3 mg, 0.417 mmol) was added as a solid and the reaction mixture was purged with nitrogen for 5 minutes before the addition of copper (II) sulfate (6.73 mg, 0.0417 mmol) in water (0.5 mL, deionized water) and stirred at room temperature for 24 hours. The reaction was quenched by adding the reaction mixture to a saturated ammonium chloride (20 mL) and conc. ammonium hydroxide (2 mL) and extracted three times with dichloromethane (15 mL). The combined organic layers were washed with brine, dried over magnesium sulfate, filtered and concentrated under reduced pressure. The crude material was purified using the CombiFlash Rf (RediSep 12 g gold silica gel column) and eluting with a gradient of 0-20% methanol/dichloromethane yielding the impure title compound (105.0 mg, None, 40%). The crude (105.0 mg) was purified again using the CombiFlash Rf (RediSep 4 g Gold silica gel column) and eluting with a gradient of 0-20% methanol/dichloromethane yielding the title compound as a gum (94.5 mg, 36%). Method C: MassLynx\Acid_3.0 Min.olp-LRMS [M+Na=1921]. $^1$H NMR (METHANOL-d$_4$) δ: 8.38 (d, J=4.7 Hz, 1H), 7.97 (s, 3H), 7.82-7.88 (m, 1H), 7.78-7.81 (m, 1H), 7.20 (t, J=5.9 Hz, 1H), 5.23 (s, 3H), 4.52-4.62 (m, 12H), 4.29 (d, J=5.9 Hz, 3H), 4.15 (t, J=6.4 Hz, 3H), 3.86-3.96 (m, 12H), 3.81-3.85 (m, 3H), 3.72-3.80 (m, 12H), 3.54-3.71 (m, 36H), 2.79 (t, J=7.2 Hz, 2H), 2.16 (t, J=7.2 Hz, 2H), 1.98 (s, 9H), 1.64-1.73 (m, 2H), 1.50-1.57 (m, 2H), 1.48 (s, 9H), 1.42 (d, J=6.6 Hz, 2H), 1.32 (s, 9H)

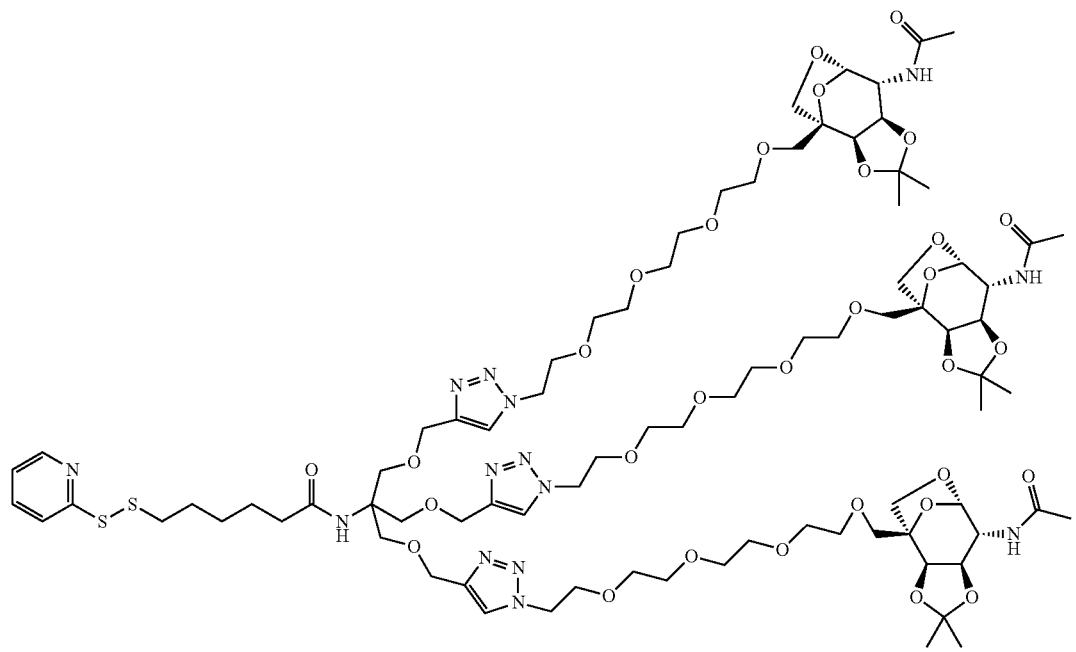 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)CCCCCSSc4ccccn4)nn3)(O2)[C@@H]2OC(C)(C)O[C@H]12]

benzyl {6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}carbamate (I-y-1)

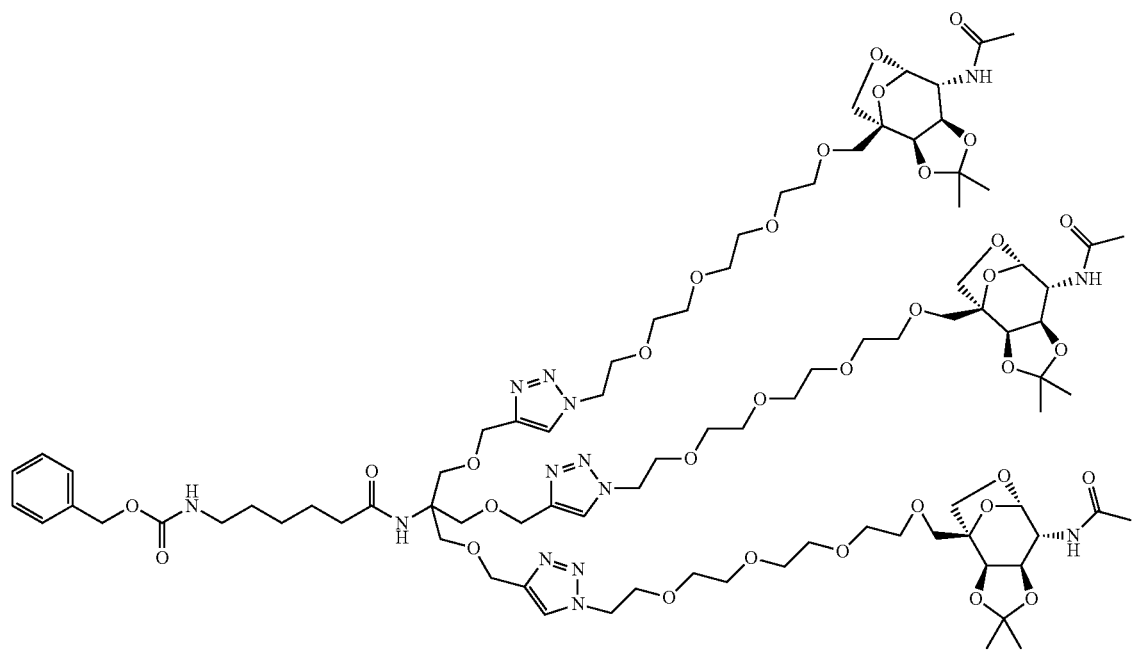 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)CCCCCNC(=O)OCc4ccccc4)nn3)(O2)[C@@H]2OC(C)(C)O[C@H]12]

A 250 mL round bottom flask equipped with stir bar was charged with benzyl [6-({1,3-bis(prop-2-yn-1-yloxy)-2-[(prop-2-yn-1-yloxy)methyl]propan-2-yl}amino)-6-oxohexyl]carbamate (I-q-1) (880.0 mg, 1.82 mmol) was added N-[(1 S,2R,6R,7R,8S)-1-(13-azido-2,5,8,11-tetraoxatridec-1-yl)-4,4-dimethyl-3,5,9,11-tetraoxatricyclo[6.2.1.0~2,6~]undec-7-yl]acetamide (I-e-2) (3075.0 mg, 6.8 mmol) in t-butanol (26 mL) followed by the addition of water (12 mL) followed by the addition of sodium ascorbate (3690 mg, 18.2 mmol) neat and the reaction was purged with nitrogen for 10 minutes. Copper (II) sulfate (294 mg, 1.82 mmol) was added in 1 mL of water and stirred at room temperature for 24 hours.

After 24 hours, the reaction was quenched by adding the reaction mixture to a saturated ammonium chloride (50 mL) and conc. ammonium hydroxide (5 mL) and extracted three times with dichloromethane (45 mL). The combined organic layers were dried over magnesium sulfate, filtered and concentrated under reduced pressure. The crude material was purified using the CombiFlash Rf (RediSep 80 g gold silica gel column) and eluting with a gradient of 0-20% methanol/dichloromethane yielding the title compound as a solid (1890.0 mg, 54.4%) and impure title compound. The crude (1270.0 mg, 36.5%) was purified using the CombiFlash Rf (RediSep 80 g gold silica gel column) and eluting with a gradient of 0-20% methanol/dichloromethane yielding the title compound (607.0 mg, 17.5%). Total yield of title compound 2.497 g (72%). Method C: 3 minute run LRMS [M+1=1907]. $^1$H NMR (METHANOL-$d_4$) δ: 7.99 (s, 3H), 7.21-7.47 (m, 5H), 5.25 (d, J=1.6 Hz, 3H), 5.07 (s, 2H), 4.53-4.62 (m, 12H), 4.31 (d, J=5.9 Hz, 3H), 4.18 (t, J=6.4 Hz, 3H), 3.88-3.98 (m, 12H), 3.85 (d, J=7.8 Hz, 3H), 3.74-3.81 (m, 12H), 3.53-3.71 (m, 36H), 3.10 (q, J=6.2 Hz, 2H), 2.18 (t, J=7.2 Hz, 2H), 2.00 (s, 9H), 1.53-1.65 (m, 2H), 1.50 (s, 11H), 1.34 (s, 11H)

N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)-6-(pyridin-2-yldisulfanyl)hexanamide (41)

A solution of N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)-6-(pyridin-2-yldisulfanyl)hexanamide (I-x-1) (94.5 mg, 0.0498 mmol) in acetic acid (4 mL), methanol (1 mL) and water (1.0 mL) was heated to 70° C. for 64 hours. After 64 hours, the reaction was cooled to room temperature and concentrated under reduced pressure. The crude material was diluted with toluene and concentrated under reduced pressure. The crude material was diluted with toluene a second time and concentrated under reduced pressure yielding impure title compound as a gum (85.3 mg). The crude material was purified using reverse phase chromatography using the conditions below yielding the title compound as a gum (47.6 mg, 53.8%).

Purification Conditions:
The residue was dissolved in dimethyl sulfoxide (1 mL) and purified by reversed-phase HPLC. Column: Waters Sunfire C18 19×100, 5 u; Mobile phase A: 0.05% TFA in water (v/v); Mobile phase B: 0.05% TFA in acetonitrile (v/v); Gradient: 80.0% H20/20.0% Acetonitrile linear to 65% H20/35% Acetonitrile in 8.5 min to 0% H20/100% MeCN to 9.0 min, Hold at 0% H20/100% Acetonitrile from 9.0 to 10.0 min. Flow: 25 mL/min. Yielding 47.6 mg of the title compound as a gum (retention time 2.87, mass observed=890.4376).

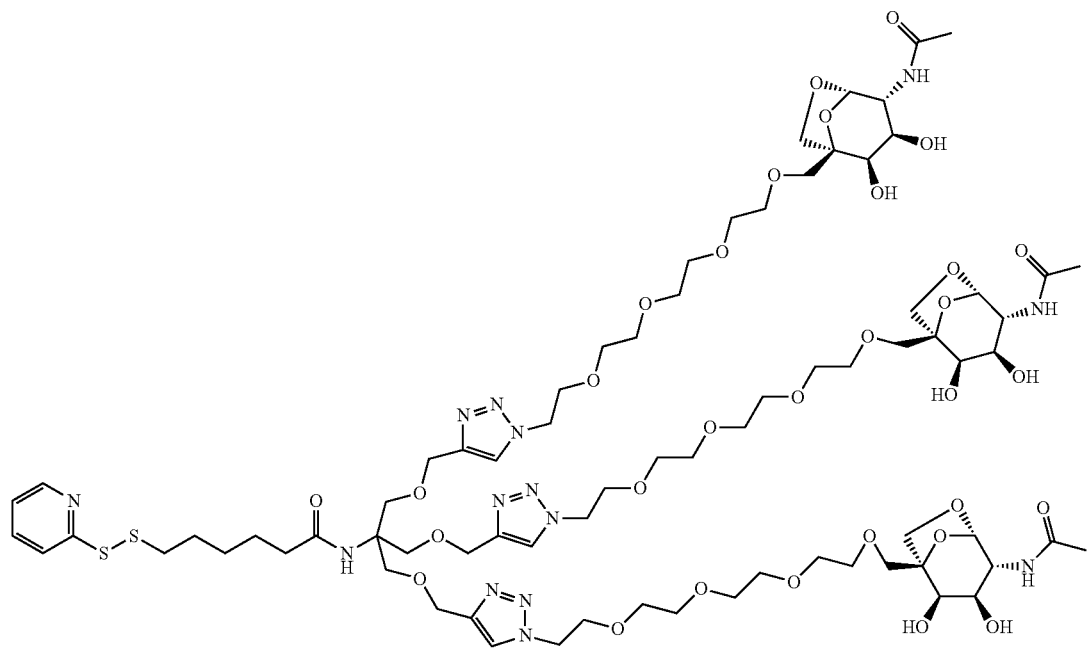 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCSSc4ccccn4)nn3)(O2)[C@H](O)[C@@H]1O]

QC Conditions:

Column: Waters Atlantis dC18 4.6×50, 5 u; Mobile phase A: 0.05% TFA in water (v/v); Mobile phase B: 0.05% TFA in acetonitrile (v/v); 95.0% H20/5.0% Acetonitrile linear to 50% H20/50% Acetonitrile in 3.75 min, to 5% H20/95% Acetonitrile to 4.0 min, Hold at 5% H20/95% Acetonitrile from 4.0 min to 5.0 min. Flow: 2 mL/min. Retention time=2.87; Mass observed=890.4376. Method C: 3 minute run LRMS [½M=889]. $^1$H NMR (METHANOL-$d_4$) δ: 8.41 (d, J=4.7 Hz, 1H), 7.99 (s, 3H), 7.84-7.91 (m, 2H), 7.26 (t, J=5.9 Hz, 1H), 5.21 (s, 3H), 4.58 (t, J=5.0 Hz, 6H), 4.56 (s, 6H), 3.95 (t, J=8.8 Hz, 6H), 3.89 (t, J=5.0 Hz, 6H), 3.86-3.88 (m, 3H), 3.74-3.78 (m, 9H), 3.71 (dd, J=9.4, 4.1 Hz, 3H), 3.54-3.67 (m, 42H), 2.80 (t, J=7.0 Hz, 2H), 2.16 (t, J=7.3 Hz, 2H), 1.99 (s, 9H), 1.68 (quin, J=7.3 Hz, 2H), 1.50-1.57 (m, 2H), 1.35-1.44 (m, 2H)

N-[(1S,2R,3R,4R,5S)-1-(13-{4-[(3-[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}-2-aminopropoxy)methyl]-1H-1,2,3-triazol-1-yl}-2,5,8,11-tetraoxatridec-1-yl)-2,3-dihydroxy-6,8-dioxabicyclo[3.2.1]oct-4-yl]acetamide hydrochloric acid salt (42)

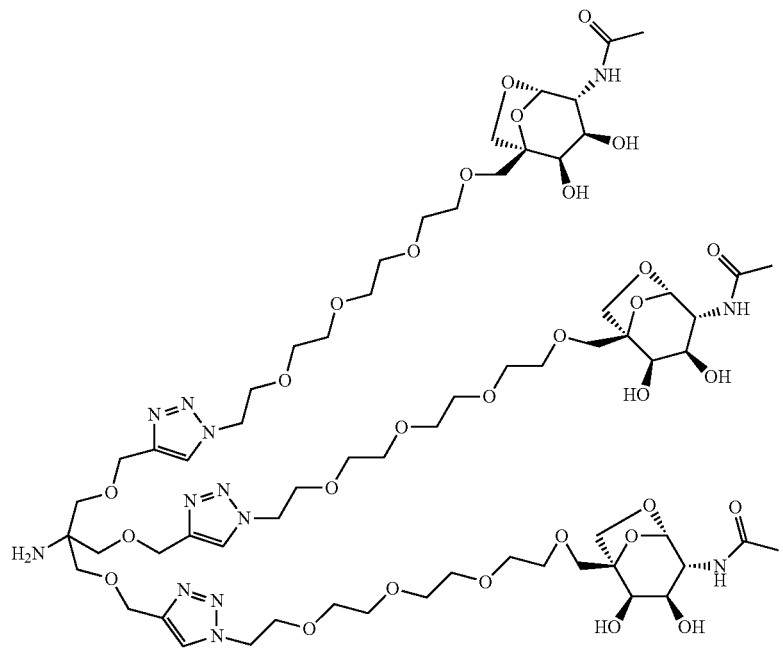 [SMILES: CC(=O)N[C@H]1[C@H]2OC[C@](COCCOCCOCCOCCn3cc(COCC(N)(COCc4cn(CCOCCOCCOCCOC[C@@]56CO[C@@H](O5)[C@H](NC(C)=O)[C@@H](O)[C@H]6O)nn4)COCc4cn(CCOCCOCCOCCOC[C@@]56CO[C@@H](O5)[C@H](NC(C)=O)[C@@H](O)[C@H]6O)nn4)nn3)(O2)[C@H](O)[C@@H]1O]

A solution of tert-butyl (1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)carbamate (I-w-1) (210 mg, 0.119 mmol) in acetic acid (8.0 mL), methanol (2.0 mL) and Water (2.0 mL) was heated to 70° C. overnight. After 18 hours, the reaction was cooled to room temperature and concentrated under reduced pressure. The crude material was diluted with toluene and methanol and concentrated under reduced pressure. The crude material was diluted with toluene a second time and concentrated under reduced pressure. The crude material was diluted with dichloromethane (10 mL) and methanol (4 mL) to which was added 4.0M hydrogen chloride in dioxane (2.0 mL, 8 mmol). The reaction mixture was stirred at room temperature overnight After 18 hours, the reaction was concentrated under reduced pressure. The crude material was diluted with ethyl acetate (1 mL) and to which was added heptane (10 mL) and concentrated under reduced pressure. The material was then placed under high vacuum for 18 hours yielding the title compound as a solid (198.8 mg, 106%). Method C: 3 minute run LRMS [M+Na=1561]. $^1$H NMR (METHANOL-$d_4$) δ: 8.13-8.21 (m, 3H), 5.22 (s, 3H), 4.71 (s, 9H), 4.65 (d, J=4.7 Hz, 6H), 3.92-4.00 (m, 12H), 3.90 (d, J=4.3 Hz, 3H), 3.58-3.80 (m, 51H), 2.02 (s, 9H)

6-azido-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hexanamide (43)

(see PCT Int. Appl., 2011034951, 24 Mar. 2011, 6.05 mg, 0.0238 mmol) and the reaction was allowed to stir at room temperature for 18 hours. The reaction was then heated to 60° C. for 32 hours. After 32 hours, the reaction was concentrated under reduced pressure. The crude material was diluted with dimethylsulfoxide (1 mL) and passed through a syringe filter and the crude material was purified using reverse-phase chromatography using the conditions seen below yielding the title compound as a gum (6.2 mg, 23%).

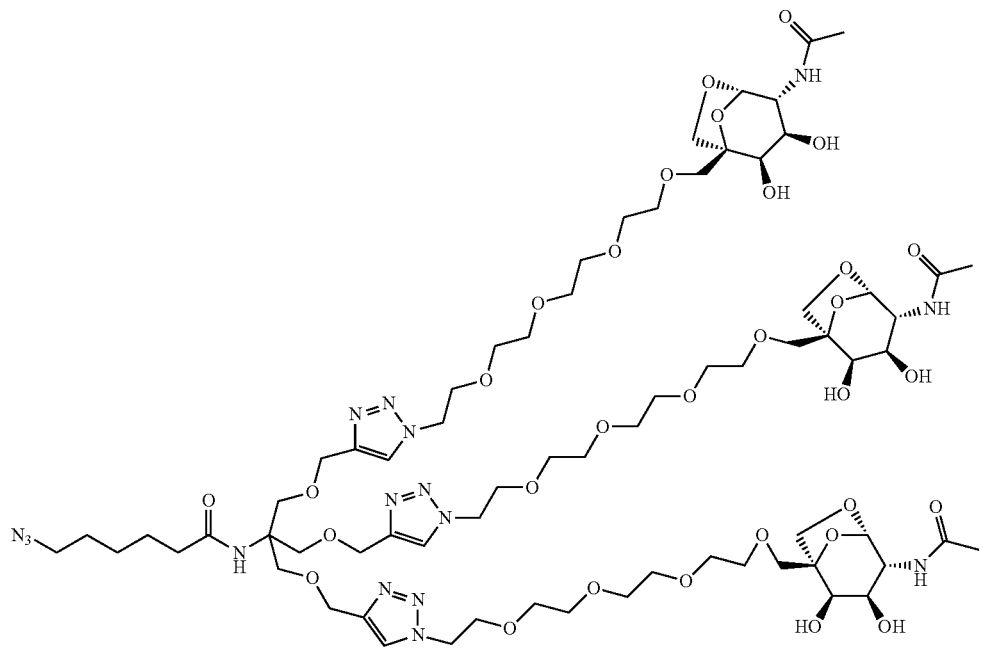 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCN=[N+]=[N-])nn3)(O2)[C@H](O)[C@@H]1O]

To a solution of N-[(1S,2R,3R,4R,5S)-1-(13-{4-[(3-[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}-2-aminopropoxy)methyl]-1H-1,2,3-triazol-1-yl}-2,5,8,11-tetraoxatridec-1-yl)-2,3-dihydroxy-6,8-dioxabicyclo[3.2.1]oct-4-yl]acetamide hydrochloric acid salt (42) (25 mg, 0.016 mmol) in N,N-dimethylformamide (0.5 mL) was added N,N-diisopropylethylamine (0.0111 mL, 0.0635 mmol) and was allowed to stir for 10 minutes before being added to neat 1-[(6-azidohexanoyl)oxy]pyrrolidine-2,5-dione

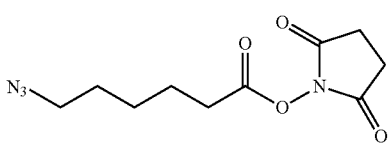 [SMILES: [N-]=[N+]=NCCCCCC(=O)ON1C(=O)CCC1=O]

Purification Conditions

The residue was dissolved in dimethyl sulfoxide (1 mL) and purified by reversed-phase HPLC (Column: Waters Sunfire C18 19×100, 5 u; Mobile phase A: 0.05% TFA in water (v/v); Mobile phase B: 0.05% TFA in acetonitrile (v/v); 90.0% H20/10.0% Acetonitrile linear to 70% H20/30% Acetonitrile in 10.5 min, 70% H20/30% Acetonitrile linear to 0% H20/100% MeCN in 0.5 min, Hold at 0% H20/100% Acetonitrile from 11.0 min to 12.0 min. Flow: 25 mL/min.

QC Conditions

Column: Waters Atlantis dC18 4.6×50, 5 u; Mobile phase A: 0.05% TFA in water (v/v); MobCe phase B: 0.05% TFA in acetonitrile (v/v); 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=1.77 minutes; Mass observed=839.7097. Method C: 3 minute run LRMS [M+1=1678]. $^1$H NMR (METHANOL-$d_4$) δ: 8.00 (s, 3H), 5.21 (s, 3H), 4.58 (t, J=4.7 Hz, 6H), 4.57 (s, 6H), 3.95 (t, J=10.0 Hz, 6H), 3.85-3.92 (m, 9H), 3.74-3.80 (m, 9H), 3.71 (dd, J=10.0, 4.1 Hz, 3H), 3.55-3.68 (m, 42H), 3.25 (t, J=6.5 Hz, 2H), 2.19 (t, J=7.3 Hz, 2H), 1.99 (s, 9H), 1.52-1.62 (m, 4H), 1.33-1.41 (m, 2H)

N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hept-6-enamide (44)

To a solution of N-[(1S,2R,3R,4R,5S)-1-(13-{4-[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}-2-aminopropoxy)methyl]-1H-1,2,3-triazol-1-yl}-2,5,8,11-tetraoxatridec-1-yl)-2,3-dihydroxy-6,8-dioxabicyclo[3.2.1]oct-4-yl]acetamide hydrochloric acid salt (42) (25 mg, 0.016 mmol) in N,N-dimethylformamide (0.5 mL) was added N,N-diisopropylethylamine (0.0111 mL, 0.0635 mmol) and was allowed to stir for 10 minutes before being added to neat 1-(hept-6-enoyloxy)pyrrolidine-2,5-dione

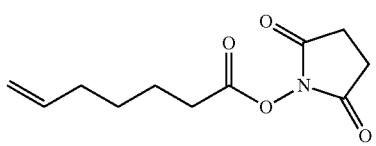

(see Angewandte Chemie, International Edition, 51(25), 6144-6148, S6144/1-S6144/53; 2012, 5.36 mg, 0.0238 mmol) and the reaction was allowed to stir at room temperature for 18 hours. The reaction was then heated to 60° C. for 32 hours. After 32 hours, the reaction was concentrated under reduced pressure. The crude material was diluted with dimethylsulfoxide (1 mL) and passed through a syringe filter and the crude material was purified using reverse-phase chromatography using the conditions seen below yielding the title compound as a gum (4.9 mg, 19%).

Purification Conditions:

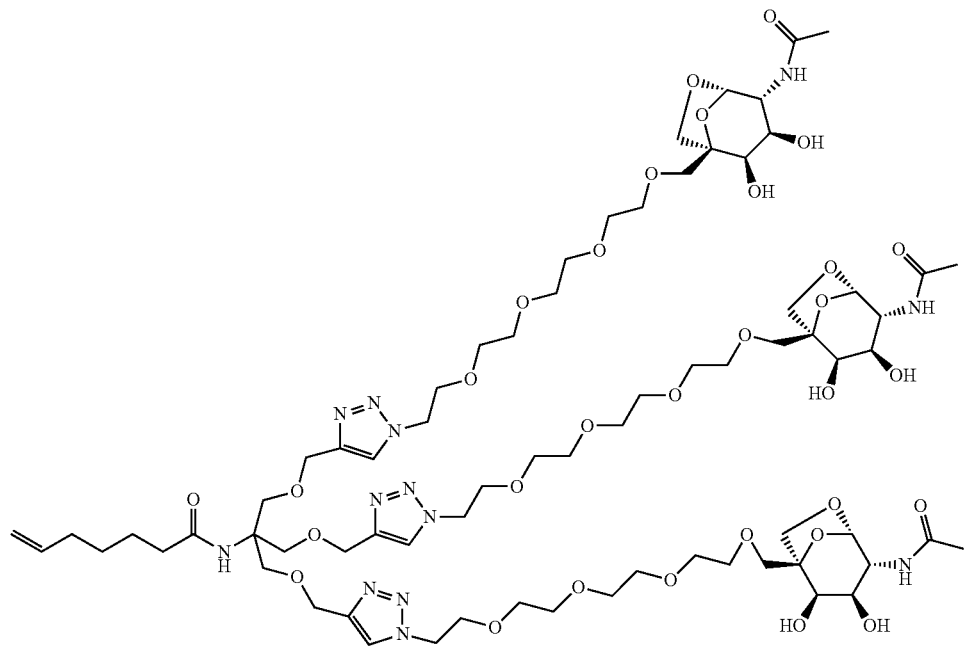 [SMILES: C=CCCCCC(=O)NC(COCc1cn(CCOCCOCCOCCOC[C@@]23CO[C@@H](O2)[C@H](NC(C)=O)[C@@H](O)[C@H]3O)nn1)(COCc1cn(CCOCCOCCOCCOC[C@@]23CO[C@@H](O2)[C@H](NC(C)=O)[C@@H](O)[C@H]3O)nn1)COCc1cn(CCOCCOCCOCCOC[C@@]23CO[C@@H](O2)[C@H](NC(C)=O)[C@@H](O)[C@H]3O)nn1]

The residue was dissolved in dimethyl sulfoxide (1 mL) and purified by reversed-phase HPLC (Column: Waters Sunfire C18 19×100, 5 u; Mobile phase A: 0.05% TFA in water (v/v); Mobile phase B: 0.05% TFA in acetonitrile (v/v); 95.0% H20/5.0% Acetonitrile linear to 55% H20/45% Acetonitrile in 10.5 min, 55% H20/45% Acetonitrile linear to 0% H20/100% MeCN in 0.5 min, Hold at 0% H20/100% Acetonitrile from 11.0 min to 12.0 min. Flow: 25 mL/min.

QC Conditions:

Column: Waters Atlantis dC18 4.6×50, 5 u; Mobile phase A: 0.05% TFA in water (v/v); Mobile phase B: 0.05% TFA in acetonitrile (v/v); 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=1.81; mass observed=825.2381). Method C: 3 minute run LRMS [M−1=1647]. $^1$H NMR (METHANOL-$d_4$) δ: 7.99 (s, 3H), 5.69-5.88 (m, 1H), 5.21 (s, 3H), 4.95 (m, 2H), 4.51-4.63 (m, 12H), 3.95 (t, J=9.7 Hz, 6H), 3.85-3.91 (m, 9H), 3.74-3.81 (m, 9H), 3.71 (dd, J=9.4, 4.1 Hz, 3H), 3.54-3.68 (m, 42H), 2.17 (t, J=7.3 Hz, 2H), 2.01-2.09 (m, 2H), 1.99 (s, 9H), 1.52-1.61 (m, 2H), 1.39 (quin, J=7.5 Hz, 2H)

N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hept-6-ynamide (45)

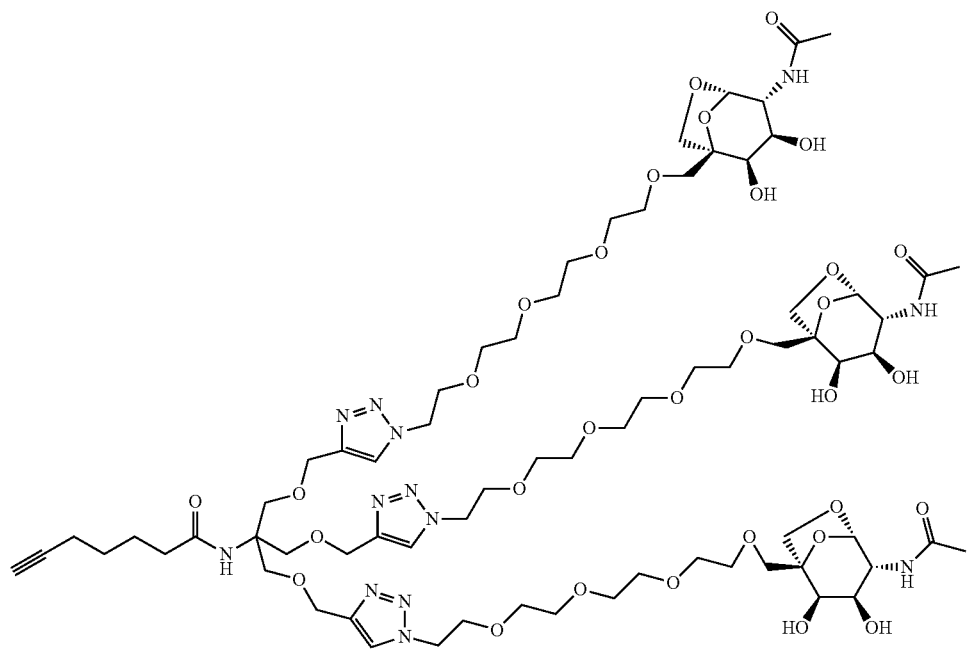 [SMILES: C#CCCCCC(=O)NC(COCc1cn(CCOCCOCCOCCOC[C@@]23CO[C@@H](O2)[C@H](NC(C)=O)[C@@H](O)[C@H]3O)nn1)(COCc1cn(CCOCCOCCOCCOC[C@@]23CO[C@@H](O2)[C@H](NC(C)=O)[C@@H](O)[C@H]3O)nn1)COCc1cn(CCOCCOCCOCCOC[C@@]23CO[C@@H](O2)[C@H](NC(C)=O)[C@@H](O)[C@H]3O)nn1]
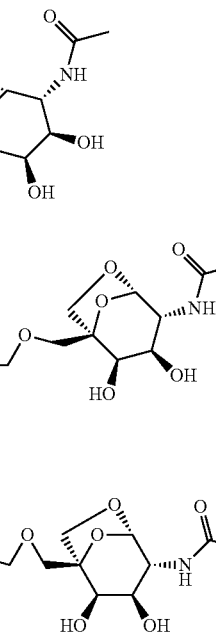

To a solution of N-[(1S,2R,3R,4R,5S)-1-(13-{4-[(3-[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}-2-aminopropoxy)methyl]-1H-1,2,3-triazol-1-yl}-2,5,8,11-tetraoxatridec-1-yl)-2,3-dihydroxy-6,8-dioxabicyclo[3.2.1]oct-4-yl]acetamide hydrochloric acid salt (42) (25 mg, 0.016 mmol) in N,N-dimethylformamide (0.5 mL) was added N,N-diisopropylethylamine (0.0111 mL, 0.0635 mmol) and was allowed to stir for 10 minutes before being added to neat 1-(hept-6-ynoyloxy)pyrrolidine-2,5-dione

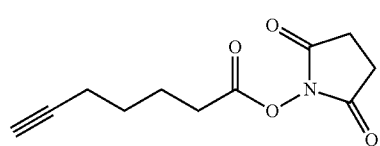 [SMILES: C#CCCCCC(=O)ON1C(=O)CCC1=O]

(see PCT Int. Appl., 2007056389, 18 May 2007, 5.31 mg, 0.0238 mmol) and the reaction was allowed to stir at room temperature for 18 hours. The reaction was then heated to 60° C. for 32 hours. After 32 hours, the reaction was concentrated under reduced pressure. The crude material was diluted with dimethylsulfoxide (1 mL) and passed through a syringe filter and the crude material was purified using reverse-phase chromatography using the conditions seen below yielding the title compound as a gum (5 mg, 19%).

Purification Conditions:

The residue was dissolved in dimethyl sulfoxide (1 mL) and purified by reversed-phase HPLC (Column: Waters Sunfire C18 19×100, 5 u; Mobile phase A: 0.05% TFA in water (v/v); Mobile phase B: 0.05% TFA in acetonitrile (v/v); 95.0% H20/5.0% Acetonitrile linear to 55% H20/45% Acetonitrile in 10.5 min, 55% H20/45% Acetonitrile linear to 0% H20/100% MeCN in 0.5 min, Hold at 0% H20/100% Acetonitrile from 11.0 min to 12.0 min. Flow: 25 mL/min.

QC Conditions:

Column: Waters Atlantis dC18 4.6×50, 5 u; Mobile phase A: 0.05% TFA in water (v/v); Mobile phase B: 0.05% TFA in acetonitrile (v/v); 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=1.68; Mass observed=824.2237. Method C: 3 minute run LRMS [½M=823]. $^1$H NMR (METHANOL-$d_4$) δ: 7.99 (s, 3H), 5.21 (s, 3H), 4.59 (t, J=5.0 Hz, 6H), 4.56 (s, 6H), 3.95 (t, J=10.0 Hz, 6H), 3.85-3.92 (m, 9H), 3.74-3.79 (m, 9H), 3.71 (dd, J=10.0, 4.1 Hz, 3H), 3.54-3.67 (m, 41H), 2.13-2.24 (m, 6H), 1.99 (s, 9H), 1.66 (quin, J=7.5 Hz, 2H), 1.50 (quin, J=7.3 Hz, 2H)

ethyl 7-[(2,5-dioxopyrrolidin-1-yl)oxy]-7-oxoheptanoate (I-z-1)

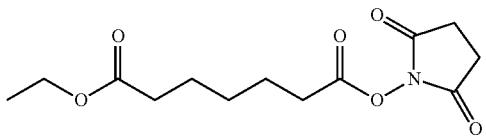 [SMILES: CCOC(=O)CCCCCC(=O)ON1C(=O)CCC1=O]

To a solution of 7-ethoxy-7-oxoheptanoic acid

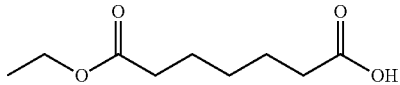

(448 mg, 2.38 mmol) in N,N-dimethylformamide (6.0 mL) was added N-Hydroxysuccinimide (329 mg, 2.86 mmol) followed by N-(3-dimethylaminopropyl)-N'-ethylcarbodiimide hydrochloride (559 mg, 2.86 mmol). The reaction was allowed to stir at room for 72 hours. After 72 hours, the reaction was quenched with water and extracted three times with dichloromethane. The combined organic layers were washed with saturated sodium bicarbonate, brine, dried over sodium sulfate, filtered and concentrated under reduced pressure. The crude material was purified using the CombiFlash Rf (RediSep 40 g gold column) and eluting with a gradient of 0-100% ethyl acetate/heptane yielding the title compound as a gum (426 mg, 63%). Method C: 1.5 minute run LRMS [M+Na=308]. $^1$H NMR (METHANOL-$d_4$) δ: 4.12 (q, J=7.0 Hz, 2H), 2.83 (s, 4H), 2.64 (t, J=7.2 Hz, 2H), 2.33 (t, J=7.2 Hz, 2H), 1.74 (quin, J=7.4 Hz, 2H), 1.58-1.68 (m, 2H), 1.40-1.53 (m, 2H), 1.24 (t, J=7.0 Hz, 3H).

7-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1 S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-7-oxoheptanoic acid (Sodium salt) (46)

1H-1,2,3-triazol-1-yl}-2,5,8,11-tetraoxatridec-1-yl)-2,3-dihydroxy-6,8-dioxabicyclo[3.2.1]oct-4-yl]acetamide-hydrochloric acid salt (42) (30.0 mg, 0.019 mmol) in N,N-dimethylformamide (0.5 mL) was added N,N-diisopropylethylamine (0.0133 mL, 0.0762 mmol) and was allowed to stir for 10 minutes before being added to neat ethyl 7-[(2,5-dioxopyrrolidin-1-yl)oxy]-7-oxoheptanoate (I-z-1) (7.4 mg, 0.026 mmol) and the reaction was allowed to stir at room temperature for 18 hours. The reaction was then heated to 60° C. for 32 hours. After 32 hours, the reaction was cooled to room temperature and concentrated under reduced pressure. The crude material was diluted with ethanol (1 mL) and water (0.03 mL) followed by the addition of 12.5M sodium hydroxide aqueous solution (0.015 mL, 0.190 mmol). The reaction was allowed to stir for 3 hours at room temperature. After 3 hours, the reaction was concentrated under reduced pressure. The crude material was diluted with dimethylsulfoxide (1 mL) and filtered through a syringe filter. The solution was purified using reverse-phase chromatography using the conditions below yielding the title compound as a gum (3.7 mg, 11%).

Purification Conditions

The residue was dissolved in dimethyl sulfoxide (1 mL) and purified by reversed-phase HPLC (Column: Waters Sunfire C18 19×100, 5 u; Mobile phase A: 0.05% TFA in water (v/v); Mobile phase B: 0.05% TFA in acetonitrile (v/v); 90.0% H20/10.0% Acetonitrile linear to 70% H20/30% Acetonitrile in 10.5 min, 70% H20/30% Acetonitrile linear to 0% H20/100% MeCN in 0.5 min, Hold at 0% H20/100% Acetonitrile from 11.0 min to 12.0 min. Flow: 25 mL/min.

QC Conditions

Column: Waters Atlantis dC18 4.6×50, 5 u; Mobile phase A: 0.05% TFA in water (v/v); Mobile phase B: 0.05% TFA in acetonitrile (v/v); 95.0% H20/5.0% Acetonitrile linear to 5%

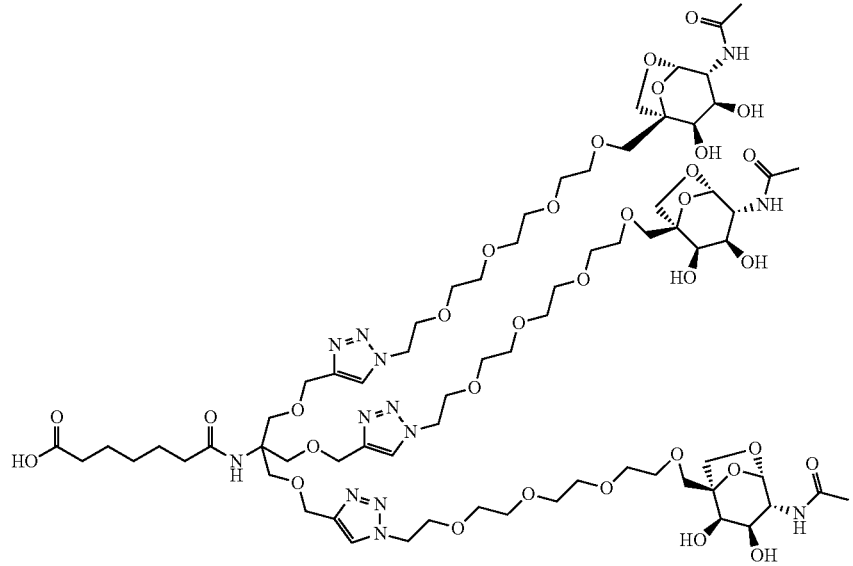 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCC(=O)O)nn3)(O2)[C@H](O)[C@@H]1O]

To a solution of N-[(1S,2R,3R,4R,5S)-1-(13-{4-[(3-[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}-2-aminopropoxy)methyl]-

H20/95% Acetonitrile in 4.0 min, Hold at 5% H20/95% Acetonitrile from 4.0 min to 5.0 min. Flow: 2 mL/min.; retention time=1.58 minutes; Mass observed=839.7097). Method C: MassLynx\Acid_3.0 Min.olp-LRMS [M+1=1681]. $^1$H NMR (METHANOL-$d_4$) δ: 7.99 (s, 3H), 5.21 (s, 3H), 4.58 (t, J=4.7 Hz, 6H), 4.56 (s, 6H), 3.95 (t, J=9.7 Hz, 6H), 3.89 (dt, J=9.8, 4.8 Hz, 9H), 3.74-3.79 (m, 9H), 3.71 (dd, J=10.0, 4.1

Hz, 3H), 3.53-3.67 (m, 42H), 2.25 (t, J=7.3 Hz, 2H), 2.17 (t, J=7.3 Hz, 2H), 1.99 (s, 9H), 1.58 (dquin, J=14.3, 7.3 Hz, 4H), 1.31-1.39 (m, 2H)

benzyl {6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}carbamate (47)

A solution of benzyl {6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}carbamate (I-y-1) (308 mg, 0.162 mmol) in acetic acid (6 mL), methanol (1.5 mL) and water (1.5 mL) was heated to 70° C. for 64 hours. After 64 hours, the reaction was cooled to room temperature and concentrated under reduced pressure. The crude material was diluted with toluene and concentrated under reduced pressure. The crude material was diluted with toluene a second time and concentrated under reduced pressure yielding

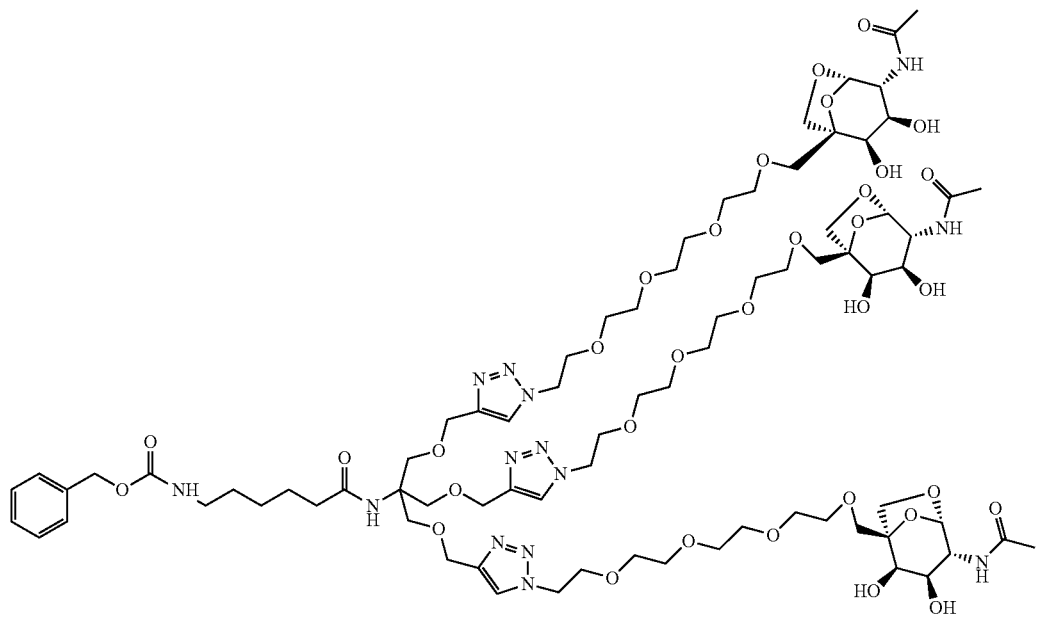 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)OCc4ccccc4)nn3)(O2)[C@H](O)[C@@H]1O]

the title compound (286 mg, None, 99%). Method C: 1.5 minute run LRMS [M+1=1787]. $^1$H NMR (METHANOL-$d_4$) δ: 7.98 (s, 3H), 7.19-7.43 (m, 5H), 5.21 (s, 3H), 5.06 (s, 2H), 4.50-4.66 (m, 12H), 3.95 (dd, J=9.6, 5.7 Hz, 6H), 3.86-3.91 (m, 9H), 3.74-3.78 (m, 9H), 3.71 (dd, J=10.0, 4.1 Hz, 3H), 3.54-3.67 (m, 42H), 3.03-3.12 (m, 2H), 2.11-2.24 (m, 2H), 1.98 (s, 9H), 1.51-1.63 (m, 2H), 1.43-1.51 (m, 2H), 1.33 (d, J=6.6 Hz, 2H).

6-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl) hexanamide acetate salt (48)

(640 mg, 0.358 mmol) was dissolved in methanol (20.0 mL) and acetic acid (0.041 mL, 0.717 mmol). The solution was then passed through the H-cube using a 10% palladium on carbon (small cartridge) using the following parameters (temperature=50° C., flow rate=1.0 mL/min., pressure=Full $H_2$ (1 bar)). The solution was collected and concentrated under reduced pressure yielding the title compound as white foam (572 mg, 93%). Method C: 3 minute run LRMS [M+1=1652].

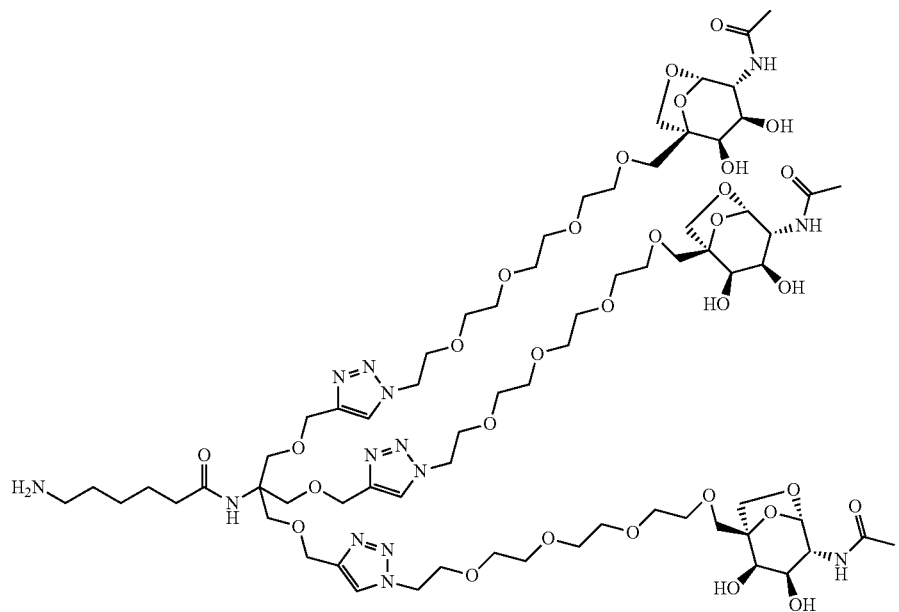 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCN)nn3)(O2)[C@H](O)[C@@H]1O]

Benzyl {6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}carbamate (47)

$^1$H NMR (METHANOL-$d_4$) δ: 8.00 (s, 3H), 5.21 (s, 3H), 4.59 (t, J=4.9 Hz, 6H), 4.56 (s, 6H), 3.95 (d, J=9.8 Hz, 6H), 3.85-3.92 (m, 9H), 3.74-3.79 (m, 9H), 3.69-3.74 (m, 3H), 3.55-3.69 (m, 42H), 2.91 (t, J=7.6 Hz, 2H), 2.20 (t, J=7.2 Hz, 2H), 1.99 (s, 9H), 1.90 (s, 3H), 1.52-1.68 (m, 4H), 1.34-1.43 (m, 2H)

N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}-6-(2,5-dioxo-2,5-dihydro-1H-pyrrol-1-yl)hexanamide (49)

The crude material was purified using reverse-phase chromatography using the conditions below yielding title compound as a gum (15.4 mg, 23%).

Purification Conditions

The residue was dissolved in dimethyl sulfoxide (1 mL) and purified by reversed-phase HPLC Column: Waters Sunfire C18 19×100, 5 u; Mobile phase A: 0.05% TFA in water (v/v); Mobile phase B: 0.05% TFA in acetonitrile (v/v); Gradient: 80.0% H20/20.0% Acetonitrile linear to 75% H20/25%

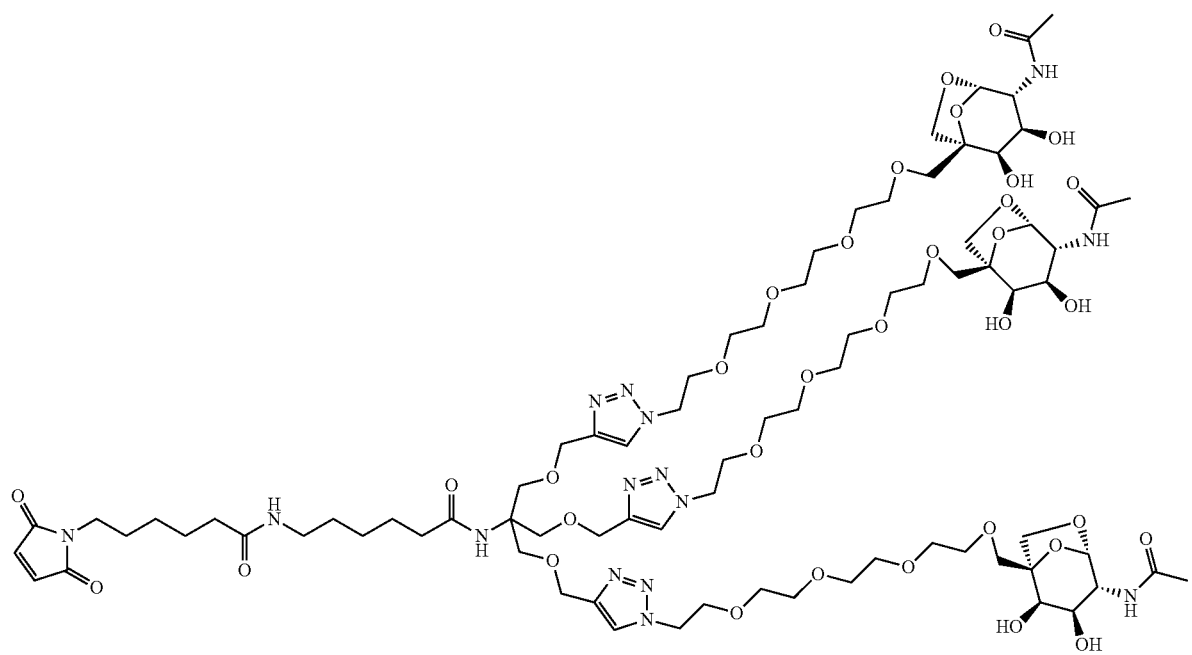 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)CCCCCN4C(=O)C=CC4=O)nn3)(O2)[C@H](O)[C@@H]1O]

To a solution of 6-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hexanamide (48) (60 mg, 0.036 mmol) in N,N-dimethylformamide (0.5 mL) and tetrahydrofuran (0.5 mL) was added N,N-diisopropylethylamine (0.0253 mL, 0.145 mmol) and 1-{6-[(2,5-dioxopyrrolidin-1-yl)oxy]-6-oxohexyl}-1H-pyrrole-2,5-dione

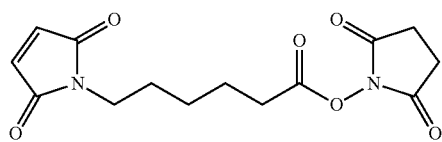 [SMILES: O=C(CCCCCN1C(=O)C=CC1=O)ON1C(=O)CCC1=O]

(12.3 mg, 0.040 mmol) room temperature 16 hours. After 16 hours, the reaction was concentrated under reduced pressure.

Acetonitrile in 10.5 min to 0% H20/100% MeCN to 11.0 min, Hold at 0% H20/100% Acetonitrile from 11.0 to 12.0 min. Flow: 25 mL/min.

QC Conditions

Column: Waters Atlantis dC18 4.6×50, 5 u; Mobile phase A: 0.05% TFA in water (v/v); Mobile phase B: 0.05% TFA in acetonitrile (v/v); Gradient: 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=1.69 minutes; mass observed=923.4907. Method C: 3 minute run LRMS [M−1=1843]. $^1$H NMR (METHANOL-$d_4$) δ: 8.00 (s, 3H), 6.80 (s, 2H), 5.21 (s, 3H), 4.59 (t, J=5.0 Hz, 6H), 4.56 (s, 6H), 3.95 (t, J=9.7 Hz, 6H), 3.90 (t, J=5.0 Hz, 6H), 3.88 (d, J=4.1 Hz, 3H), 3.74-3.79 (m, 9H), 3.71 (dd, J=10.0, 4.1 Hz, 3H), 3.55-3.68 (m, 42H), 3.48 (t, J=7.0 Hz, 2H), 3.12 (t, J=7.0 Hz, 2H), 2.11-2.23 (m, 4H), 1.99 (s, 9H), 1.53-1.66 (m, 6H), 1.48 (quin, J=7.2 Hz, 2H), 1.24-1.36 (m, 4H)

N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}-6-[(bromoacetyl)amino]hexanamide (50)

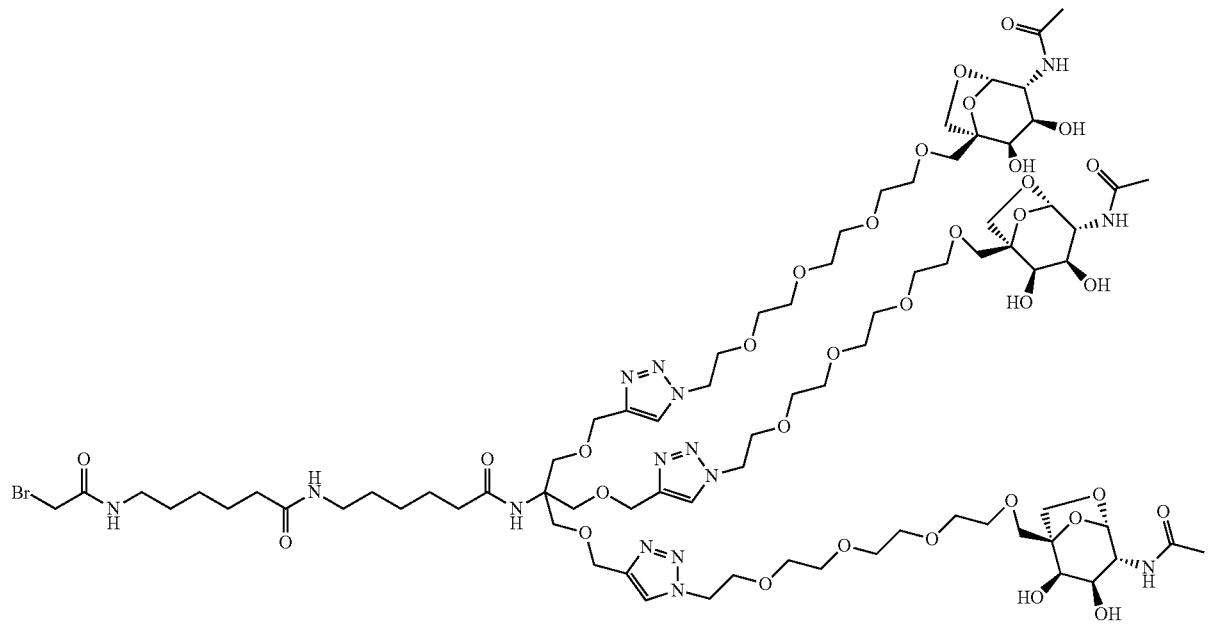 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)CCCCCNC(=O)CBr)nn3)(O2)[C@H](O)[C@@H]1O]

To a solution of 6-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hexanamide (48) (60 mg, 0.036 mmol) in N,N-dimethylformamide (0.5 mL) and tetrahydrofuran (0.5 mL) was added N,N-diisopropylethylamine (0.0253 mL, 0.145 mmol) and pentafluorophenyl 6-[(bromoacetyl)amino]hexanoate

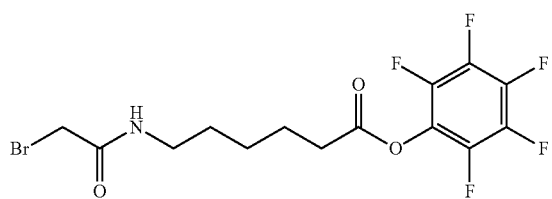 [SMILES: O=C(CBr)NCCCCCC(=O)Oc1c(F)c(F)c(F)c(F)c1F]

(see Chemistry—A European Journal, 14(16), 4939-4947; 2008, 16.7 mg, 0.0400 mmol) room temperature 16 hours. After 16 hours, the reaction was concentrated under reduced pressure. The crude material was purified using reverse-phase chromatography using the conditions below yielding the title compound as a gum (4.4 mg, 6.4%). Mass observed: 944.1543

Purification Conditions

The residue was dissolved in dimethyl sulfoxide (1 mL) and purified by reversed-phase HPLC Column: Waters Sunfire C18 19×100, 5 u; Mobile phase A: 0.05% TFA in water (v/v); Mobile phase B: 0.05% TFA in acetonitrile (v/v); Gradient: 80.0% H20/20.0% Acetonitrile linear to 75% H20/25% Acetonitrile in 10.5 min to 0% H20/100% MeCN to 11.0 min, Hold at 0% H20/100% Acetonitrile from 11.0 to 12.0 min. Flow: 25 mL/min.

QC Conditions

Column: Waters Atlantis dC18 4.6×50, 5 u; Mobile phase A: 0.05% TFA in water (v/v); Mobile phase B: 0.05% TFA in acetonitrile (v/v); Gradient: 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=1.64 minutes; mass observed=944.1543. Method C: 3 minute run LRMS [M+1=1886]. $^1$H NMR (METHANOL-d$_4$) δ: 7.99 (s, 3H), 5.21 (s, 3H), 4.57-4.62 (m, 6H), 4.56 (s, 6H), 3.92-3.98 (m, 6H), 3.83-3.91 (m, 10H), 3.80 (s, 2H), 3.69-3.79 (m, 12H), 3.54-3.68 (m, 43H), 3.13 (t, J=6.7 Hz, 2H), 2.18 (d, J=6.5 Hz, 4H), 1.98 (s, 9H), 1.59-1.67 (m, 2H), 1.51-1.59 (m, 4H), 1.48 (br. s., 2H), 1.27-1.41 (m, 4H)

9H-fluoren-9-ylmethyl {(1S)-1-cyclopentyl-2-[(2,5-dioxopyrrolidin-1-yl)oxy]-2-oxoethyl}carbamate (I-aa-1)

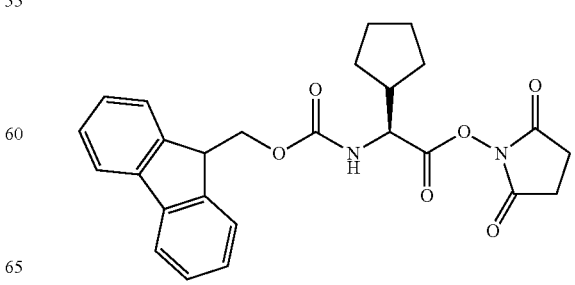

N,N'-Dicyclohexylcarbodiimide (247 mg, 1.2 mmol) was added portionwise to a solution of (2S)-cyclopentyl{[(9H-fluoren-9-ylmethoxy)carbonyl]amino}ethanoic acid

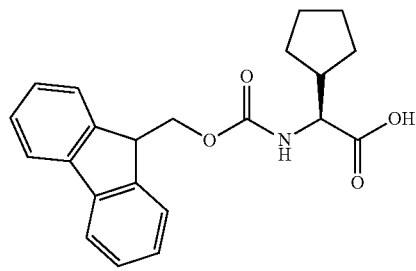 [SMILES: O=C(N[C@H](C(=O)O)C1CCCC1)OCC1c2ccccc2-c2ccccc21]

(380 mg, 1.04 mmol) and N-Hydroxysuccinimide (137.6 mg, 1.2 mmol) in dry tetrahydrofuran (40 mL) at 5-10° C. After the addition, the mixture was stirred at room temperature overnight. The mixture was cooled to −20° C., then filtered to remove by-product. The filter cake was washed by cold tetrahydrofuran, the filtrate was concentrated to dryness, purified by flash column (eluted with petroleum ether: ethyl acetate from 100:10 to 100:50) to afford the title compound (380 mg, 79%).

N~5~-carbamoyl-N~2~-[(2S)-2-cyclopentyl-2-{[(9H-fluoren-9-ylmethoxy)carbonyl]amino}acetyl]-L-ornithine (I-ab-1)

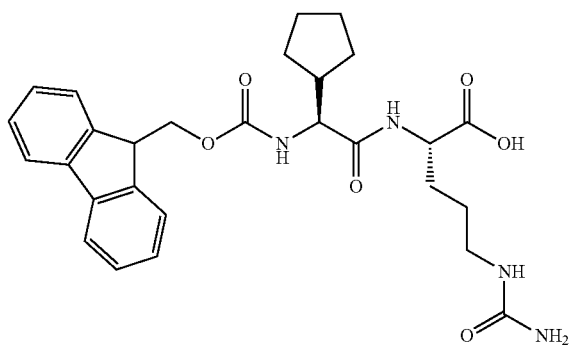 [SMILES: NC(=O)NCCC[C@H](NC(=O)[C@@H](NC(=O)OCC1c2ccccc2-c2ccccc21)C1CCCC1)C(=O)O]

To the solution of (2S)-2-amino-5-(carbamoylamino)pentanoic acid (151 mg, 0.86 mmol) and sodium bicarbonate (72.5 mg, 0.86 mmol) in water (15 mL) was added tetrahydrofuran (10 mL) at 0° C. To the resulted mixture was added a solution of 9H-fluoren-9-ylmethyl {(1S)-1-cyclopentyl-2-[(2,5-dioxopyrrolidin-1-yl)oxy]-2-oxoethyl}carbamate (I-aa-1) (380 mg, 0.82 mmol) in 1,2-dimethoxy-ethane (15 mL) dropwise under nitrogen. After addition, the mixture was stirred at room temperature overnight. The reaction mixture was washed by methyl-tertbutyl ether (50 mL) 4 times. The organic phase was discarded and the aqueous layer was acidified to pH=3-4 by aqueous hydrochloric acid (1 M). The solution was extracted using chloroform/isopropyl alcohol (4:1) (50 mL) 6 times. Combined organic layer was dried over sodium sulfate, concentrated to dryness to afford the title compound (403 mg, 93.7%) as white solid.

9H-fluoren-9-ylmethyl [(1S)-2-{[(2S)-5-(carbamoylamino)-1-{[4-(hydroxymethyl)phenyl]amino}-1-oxopentan-2-yl]amino}-1-cyclopentyl-2-oxoethyl]carbamate (I-ac-1)

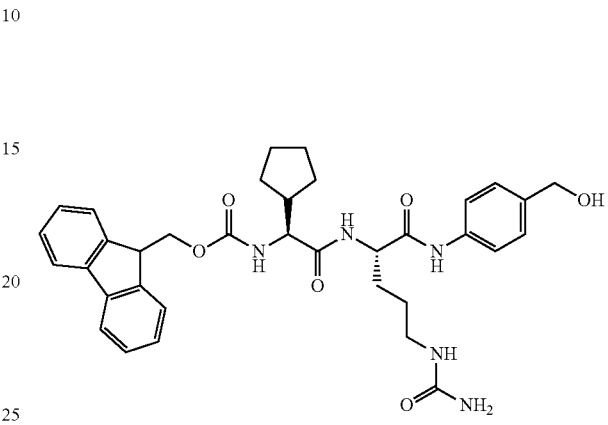

To the solution of N~5~-carbamoyl-N~2~-[(2S)-2-cyclopentyl-2-{[(9H-fluoren-9-ylmethoxy)carbonyl]amino}acetyl]-L-ornithine (I-ab-1) (500 mg, 0.95 mmol) and 4-aminobenzyl alcohol (470 mg, 3.82 mmol) in dichloromethane/methanol (30 mL/15 mL) was added N-Ethoxycarbonyl-2-ethoxy-1,2-dihydroquinoline (708 mg, 2.86 mmol). Then the reaction mixture was stirred at room temperature overnight in darkness. The following morning, the reaction was concentrated under reduced pressure and the residue was washed by methyl tert-butyl ether (100 mL×3). Then the filter cake was purified by prep-HPLC (see conditions below) to give the title compound as yellow solid (31 mg, 5.1%). 1H NMR (400 MHz, DMSO): δ 9.95 (s, 1H), 8.09 (d, 1H), 7.90-7.88 (d, 2H), 7.73-7.71 (t, 2H), 7.55-7.53 (t, 2H), 7.41 (t, 2H), 7.34-7.30 (t, 2H), 7.24-7.22 (d, 2H), 5.96 (t, 1H), 5.39 (s, 2H), 5.11-5.08 (t, 1H), 4.44-4.42 (d, 3H), 4.32-4.23 (m, 3H), 3.96-3.92 (t, 1H), 3.01-3.00 (m, 3H), 2.15-2.13 (m, 1H), 1.66-1.24 (m, 12H), m/z for C35H41N5O6: 628.4 (M+H)+, Retention time: 4.213 min Purification Conditions:

Column: DIKMA Diamonsil (2) C18 200*20 mm*5 um; mobile phase: from 30% acetonitrile in water (0.1% TFA) to 50% acetonitrile in water (0.1% TFA); wavelength=220 nm; workup: concentrated and lyophilized.

QC Conditions:

Column: Ultimate XB-C18, 3*50 mm, 3 um; Retention time: 4.33 min; Mobile phase: A, water (2.7 mL TFA in 4 L water) B, acetonitrile (2.5 mL TFA in 4 L acetonitrile) elution gradient 1%-100%; Wavelength: 220 nm; ee value: 100%. Column: Chiralcel OD-3 50*4.6 mm I.D., 3 um; retention time: 1.923 minutes; Mobile phase: ethanol (0.05% DEA) in CO2 from 5% to 40%; flow rate: 2.5 mL/minutes; Wavelength: 254 nm; ee value=100%. Column: AD-3 50*4.6 mm I.D., 3 um; retention time: 1.981 min.; Mobile phase: ethanol (0.05% DEA) in CO2 from 5% to 40%; Flow rate: 2.5 mL/min.; wavelength: 220 nm N~2~-[(2S)-2-amino-2-cyclopentylacetyl]-N~5~-carbamoyl-N-[4-(hydroxymethyl)phenyl]-L-ornithinamide (I-ad-1)

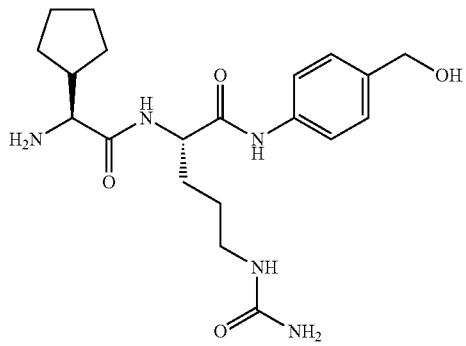 [SMILES: NC(=O)NCCC[C@H](NC(=O)[C@@H](N)C1CCCC1)C(=O)Nc1ccc(CO)cc1]

To a stirred solution of 9H-fluoren-9-ylmethyl [(1S)-2-{[(2S)-5-(carbamoylamino)-1-{[4-(hydroxymethyl)phenyl]amino}-1-oxopentan-2-yl]amino}-1-cyclopentyl-2-oxoethyl]carbamate (I-ac-1) (500 mg, 0.797 mmol) in N,N-dimethylformamide (10 mL) was added drop wise piperidine (4 mL) at 5° C. under nitrogen. The mixture was stirred at room temperature for 1.5 hours. The reaction was concentrated to dryness. The crude product was washed with dichloromethane (20 mL), filtered and filter cake was dried in vacuum to give the title compound (300 mg, 93.1%) as solid which was used for next step without purification.

N-[(1S)-2-{[(2S)-5-(carbamoylamino)-1-{[4-(hydroxymethyl)phenyl]amino}-1-oxopentan-2-yl]amino}-1-cyclopentyl-2-oxoethyl]-6-(2,5-dioxo-2,5-dihydro-1H-pyrrol-1-yl)hexanamide (I-ae-1)

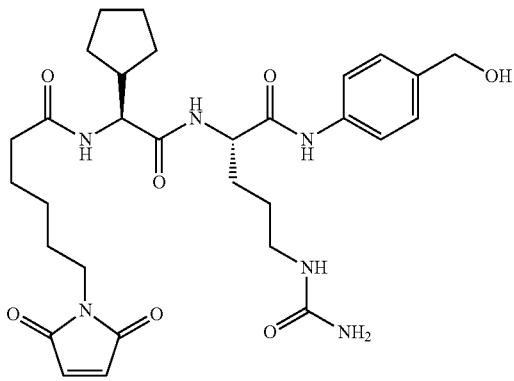 [SMILES: NC(=O)NCCC[C@H](NC(=O)[C@@H](NC(=O)CCCCCN1C(=O)C=CC1=O)C1CCCC1)C(=O)Nc1ccc(CO)cc1]

To a stirred solution of N~2~-[(2S)-2-amino-2-cyclopentylacetyl]-N~5~-carbamoyl-N-[4-(hydroxymethyl)phenyl]-L-ornithinamide (I-ad-1) (300 mg, 0.74 mmol) in N,N-dimethylformamide (12 mL) was added 1-{6-[(2,5-dioxopyrrolidin-1-yl)oxy]-6-oxohexyl}-1H-pyrrole-2,5-dione (272 mg, 0.889 mmol) at 3° C. under nitrogen. The mixture was stirred at room temperature for 2 hours. The reaction was added drop wise into methyl tert-butyl ether (250 mL), stirred at room temperature for 20 min, filtered and filter cake was concentrated to dryness to give the title compound (300 mg, 67.8%) as solid which was used for next step without purification.

N~5~-carbamoyl-N~2~-[(2S)-2-cyclopentyl-2-{[6-(2,5-dioxo-2,5-dihydro-1H-pyrrol-1-yl)hexanoyl]amino}acetyl]-N-[4-({[(4-nitrophenoxy)carbonyl]oxy}methyl)phenyl]-L-ornithinamide (I-af-1)

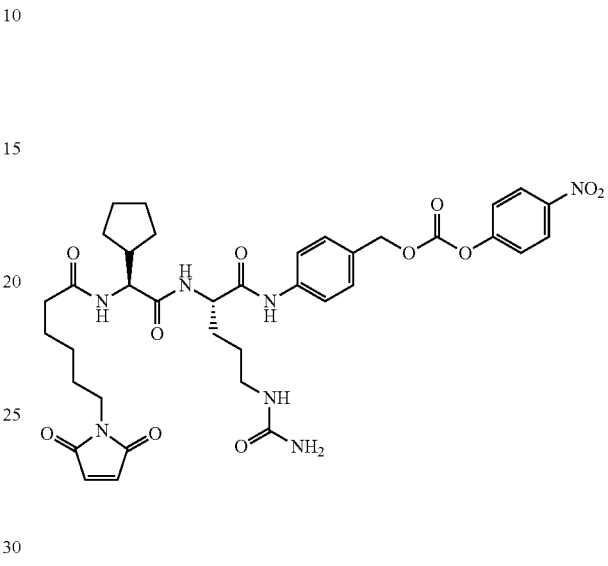

To a stirred solution of N-[(1S)-2-{[(2S)-5-(carbamoylamino)-1-{[4-(hydroxymethyl)phenyl]amino}-1-oxopentan-2-yl]amino}-1-cyclopentyl-2-oxoethyl]-6-(2,5-dioxo-2,5-dihydro-1H-pyrrol-1-yl)hexanamide (I-ae-1) (300 mg, 0.740 mmol) in N,N-dimethylformamide (12 mL) was added bis(4-nitrophenyl) carbonate (900 mg, 2.96 mmol) and N,N-diisopropylethylamine (390 mg, 2.96 mmol) at 3° C. under nitrogen. The reaction was stirred at room temperature for overnight. The reaction was added drop wise into methyl tert-butyl ether (60 mL), stirred at room temperature for 20 min, filtered and filter cake was washed with methyl tert-butyl ether (100 mL). The crude product was dried in vacuum to dryness. The crude product was purified by flash column eluted with dichloromethane: methanol from 100:1 to 94:6 to afford the title compound (50 mg, 17.7%) as solid. 1H NMR (400 MHz, DMSO): 610.09 (br, 1H), 8.33 (d, 2H), 8.13 (d, 1H), 7.93 (d, 1H), 7.67-7.41 (m, 6H), 7.01 (s, 2H), 5.98 (br, 1H), 5.43 (s, 2H), 5.25 (s, 2H), 4.39 (m, 1H), 4.23-4.19 (m, 1H), 3.37 (m, 1H), 3.03-2.96 (m, 2H), 2.14-2.11 (m, 3H), 1.70-1.19 (m, 19H). LC-MS: m/z for C37H45N7O11: 764.3 (M+H)+; Retention time: 0.823 min.

4-{[(2R)-5-(carbamoylamino)-2-{[(2R)-2-cyclopentyl-2-{[6-(2,5-dioxo-2,5-dihydro-1H-pyrrol-1-yl)hexanoyl]amino}acetyl]amino}pentanoyl]amino}benzyl {6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}carbamate (51)

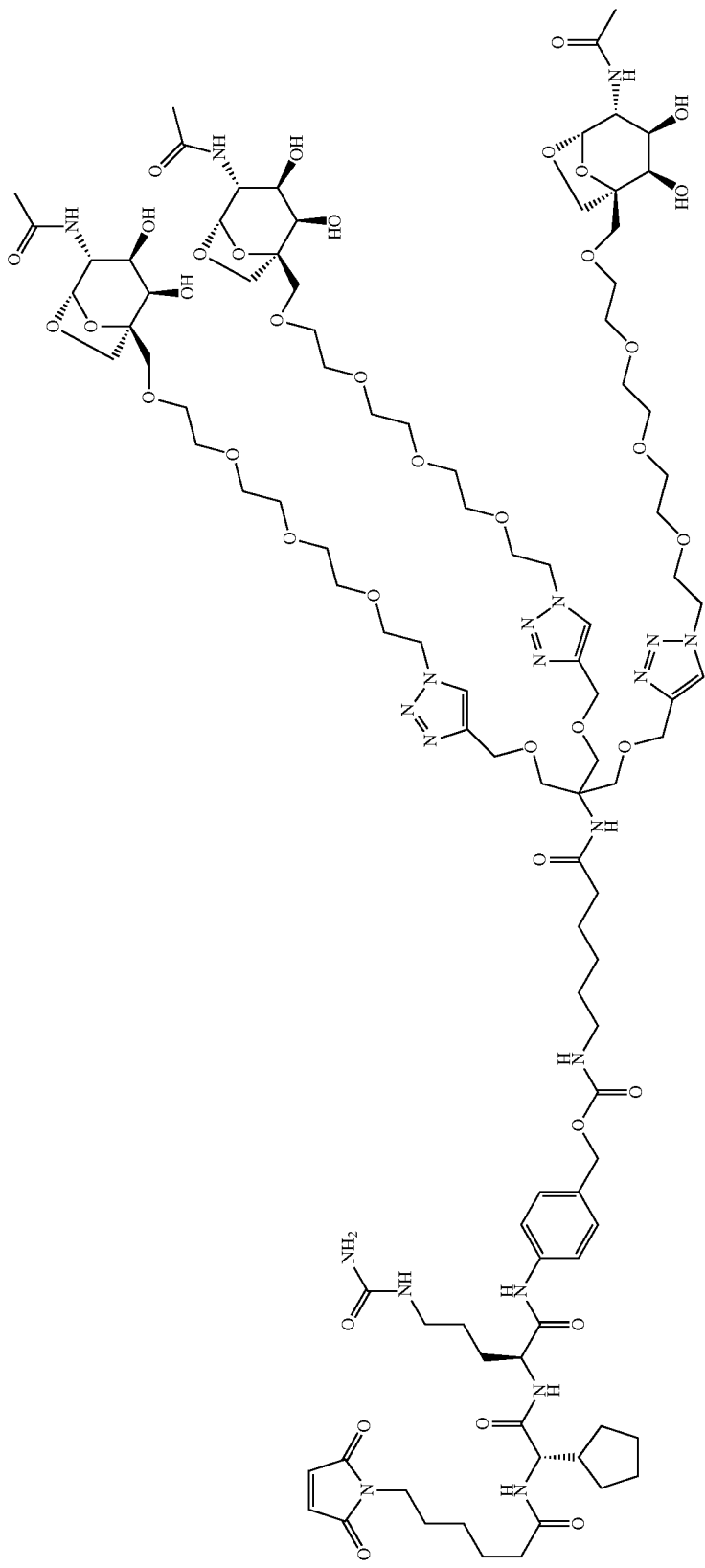

To a solution of 6-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hexanamide (48) (45 mg, 0.027 mmol) in N,N-dimethylformamide (0.5 mL) and tetrahydrofuran (0.3 mL) was added N,N-diisopropylethyl amine (0.019 mL, 0.109 mmol) and N~5-carbamoyl-N~2~-[(2S)-2-cyclopentyl-2-{[6-(2,5-dioxo-2,5-dihydro-1H-pyrrol-1-yl)hexanoyl]amino}acetyl]-N-[4-({[(4-nitrophenoxy)carbonyl]oxy}methyl)phenyl]-L-ornithinamide (I-af-1) (20.8 mg, 0.0272 mmol) room temperature 18 hours. After 18 hours, a sample was removed and the UPLC showed the formation of the desired product. The crude reaction mixture was concentrated under reduced pressure. The resulting crude material was purified by reverse-phase chromatography using the conditions below yielding the title compound as a gum (21.7 mg, 35%).

Purification Conditions:

The residue was dissolved in dimethyl sulfoxide (1 mL) and purified by reversed-phase HPLC Column: Waters Sunfire C18 19×100, 5 u; Mobile phase A: 0.05% TFA in water (v/v); Mobile phase B: 0.05% TFA in acetonitrile (v/v); Gradient: 75.0% H20/25.0% Acetonitrile linear to 65% H20/35% Acetonitrile in 10.5 min to 0% H20/100% MeCN to 11.0 min, Hold at 0% H20/100% Acetonitrile from 11.0 to 12.0 min. Flow: 25 mL/min.

QC Conditions:

Column: Waters Atlantis dC18 4.6×50, 5 u; Mobile phase A: 0.05% TFA in water (v/v); Mobile phase B: 0.05% TFA in acetonitrile (v/v); 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; retention time=1.99 minutes; Retention time=1.99 minutes; Mass observed=1139.1254. Method C: 1.5 minute run LRMS [½M=1138]. $^1$H NMR (METHANOL-$d_4$) δ: 7.99 (s, 3H), 7.57 (d, J=8.2 Hz, 2H), 7.30 (d, J=8.2 Hz, 2H), 6.79 (s, 2H), 5.21 (s, 3H), 5.01 (s, 2H), 4.55-4.64 (m, 12H), 4.51 (dd, J=9.0, 5.1 Hz, 1H), 4.43 (q, J=7.2 Hz, 1H), 4.16 (d, J=9.4 Hz, 1H), 3.95 (d, J=9.8 Hz, 6H), 3.85-3.91 (m, 9H), 3.74-3.79 (m, 9H), 3.71 (dd, J=9.8, 4.3 Hz, 3H), 3.54-3.67 (m, 41H), 3.47 (t, J=7.0 Hz, 2H), 3.16-3.26 (m, 1H), 3.10-3.16 (m, 1H), 3.07 (t, J=6.8 Hz, 2H), 2.24 (q, J=7.7 Hz, 3H), 2.16 (t, J=7.4 Hz, 2H), 1.99 (s, 9H), 1.85-1.95 (m, 1H), 1.42-1.84 (m, 16H), 1.37 (t, J=7.0 Hz, 2H), 1.23-1.34 (m, 5H)

N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1 S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)-3,19-dioxo-1-(pyridin-2-yldisulfanyl)-7,10,13,16-tetraoxa-4,20-diazahexacosan-26-amide (52)

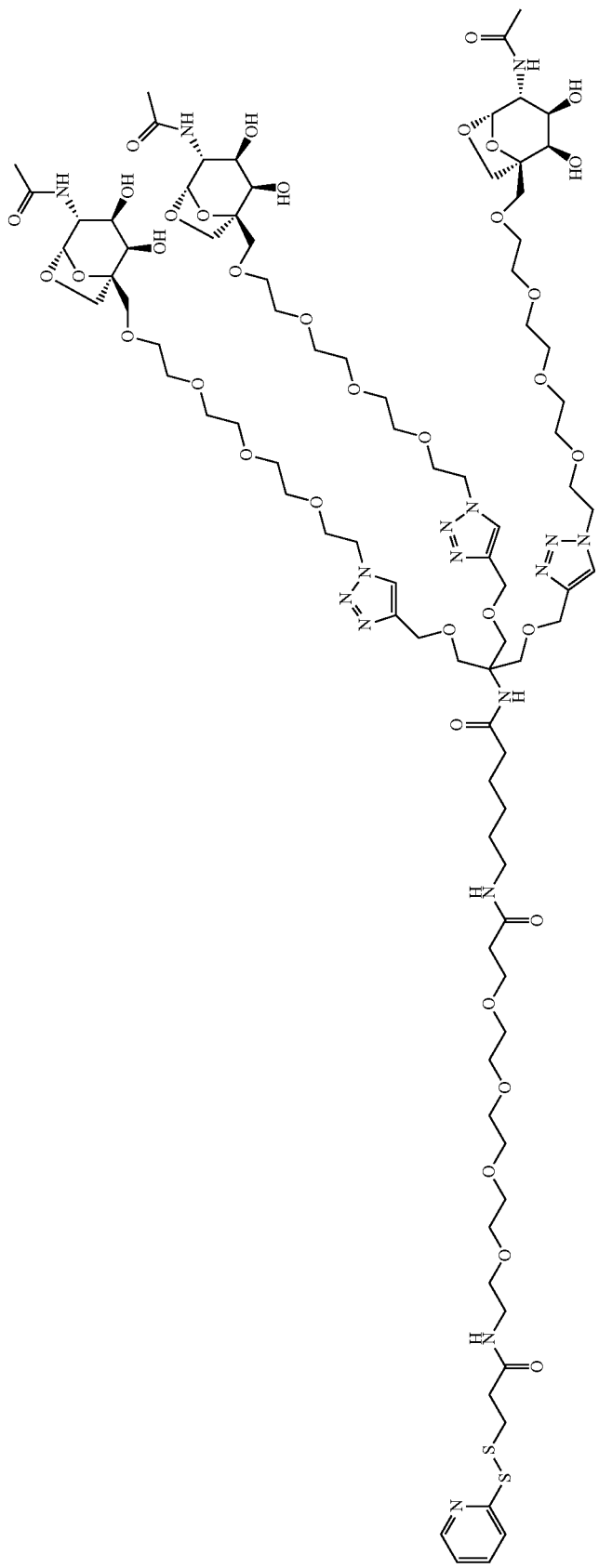

To a solution of 6-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hexanamide acetate salt (48) (70.0 mg, 0.041 mmol) and N-{15-[(2,5-dioxopyrrolidin-1-yl)oxy]-15-oxo-3,6,9,12-tetraoxapentadec-1-yl}-3-(pyridin-2-yldisulfanyl)propanamide

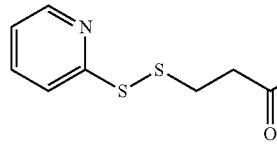
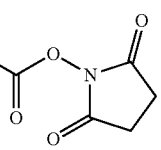

(27.5 mg, 0.0491 mmol) in N,N-dimethylformamide (0.6 mL) and tetrahydrofuran (0.6 mL) was added N,N-diisopropylethylamine (0.0285 mL, 0.164 mmol). The reaction was allowed to stir at room temperature 18 hours. After 18 hours, the reaction was concentrated under reduced pressure. The crude material was purified using reverse-phase chromatography using the conditions below yielding the title compound as a gum (47.7 mg, 56%). Method C: 3 minute run LRMS [113M+1=699]. $^1$H NMR (METHANOL-$d_4$) δ: 8.47 (d, J=4.7 Hz, 1H), 8.01 (s, 3H), 7.93 (d, J=3.5 Hz, 2H), 7.30-7.38 (m, 1H), 5.21 (s, 3H), 4.57-4.62 (m, 6H), 4.57 (s, 6H), 3.92-3.99 (m, 6H), 3.89 (dd, J=10.7, 4.9 Hz, 9H), 3.74-3.80 (m, 9H), 3.72 (dd, J=9.8, 4.7 Hz, 6H), 3.51-3.68 (m, 55H), 3.35-3.41 (m, 2H), 3.14 (t, J=7.0 Hz, 2H), 3.10 (t, J=6.8 Hz, 2H), 2.64 (t, J=7.0 Hz, 2H), 2.43 (t, J=6.0 Hz, 2H), 2.17 (t, J=7.4 Hz, 2H), 1.99 (s, 9H), 1.52-1.61 (m, 2H), 1.43-1.51 (m, 2H), 1.27-1.38 (m, 2H)

Purification Conditions

The residue was dissolved in dimethyl sulfoxide (1 mL) and purified by reversed-phase HPLC Column: Waters Sunfire C18 19×100, 5 u; Mobile phase A: 0.05% TFA in water (v/v); Mobile phase B: 0.05% TFA in acetonitrile (v/v); Gradient: 80.0% H20/20.0% Acetonitrile linear to 70% H20/30% Acetonitrile in 8.5 min to 0% H20/100% MeCN to 9.0 min, Hold at 0% H20/100% Acetonitrile from 9.0 to 10.0 min. Flow: 25 mL/min.

QC Conditions

Column: Waters Atlantis dC18 4.6×50, 5 u; Mobile phase A: 0.05% TFA in water (v/v); Mobile phase B: 0.05% TFA in acetonitrile (v/v); Gradient: 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=1.78 minutes; mass observed=699.6404

N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1 S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)-3,31-dioxo-1-(pyridin-2-yldisulfanyl)-7,10,13,16,19,22,25,28-octaoxa-4,32-diazaoctatriacontan-38-amide (53)

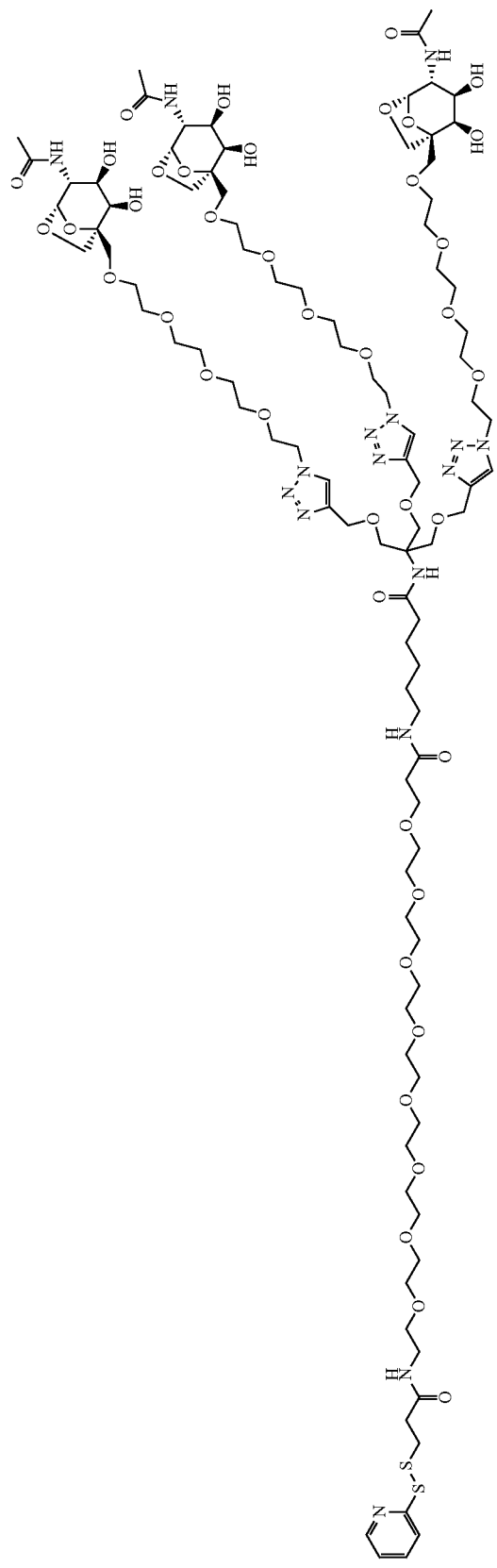

To a solution of 6-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hexanamide acetate salt (48) (70.0 mg, 0.041 mmol) and N-{27-[(2,5-dioxopyrrolidin-1-yl)oxy]-27-oxo-3,6,9,12,15,18,21,24-octaoxaheptacos-1-yl}-3-(pyridin-2-yldisulfanyl)propanamide

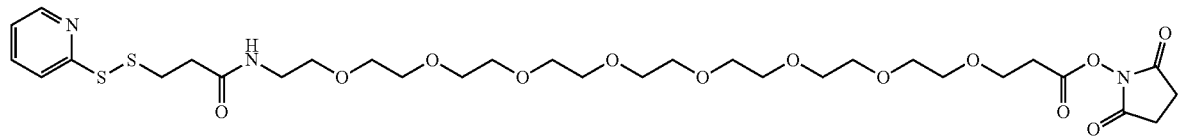 [SMILES: O=C(CCSSc1ccccn1)NCCOCCOCCOCCOCCOCCOCCOCCOCCC(=O)ON1C(=O)CCC1=O]

(30.1 mg, 0.041 mmol) in N,N-dimethylformamide (0.6 mL) and tetrahydrofuran (0.6 mL) was added N,N-diisopropylethylamine (0.0285 mL, 0.164 mmol). The reaction was allowed to stir at room temperature 18 hours. After 18 hours, the reaction was concentrated under reduced pressure. The crude material was purified using reverse-phase chromatography using the conditions below yielding the title compound as a gum (59.2 mg, 64%). Method C: 3 minute run LRMS [⅓M=757]. $^1$H NMR (METHANOL-$d_4$) δ: 8.47 (d, J=5.1 Hz, 1H), 8.01 (s, 3H), 7.92 (d, J=3.5 Hz, 2H), 7.30-7.39 (m, 1H), 5.21 (s, 3H), 4.57-4.62 (m, 6H), 4.57 (s, 6H), 3.92-3.99 (m, 6H), 3.86-3.92 (m, 9H), 3.77 (s, 9H), 3.69-3.74 (m, 6H), 3.50-3.68 (m, 73H), 3.14 (t, J=7.0 Hz, 2H), 3.10 (t, J=7.0 Hz, 2H), 2.64 (t, J=6.8 Hz, 2H), 2.43 (t, J=6.0 Hz, 2H), 2.17 (t, J=7.4 Hz, 2H), 1.99 (s, 9H), 1.53-1.63 (m, 2H), 1.42-1.52 (m, 2H), 1.32 (dt, J=15.1, 7.5 Hz, 2H)

Purification Conditions

The residue was dissolved in dimethyl sulfoxide (1 mL) and purified by reversed-phase HPLC Column: Waters Sunfire C18 19×100, 5 u; Mobile phase A: 0.05% TFA in water (v/v); Mobile phase B: 0.05% TFA in acetonitrile (v/v); Gradient: 80.0% H20/20.0% Acetonitrile linear to 70% H20/30% Acetonitrile in 8.5 min to 0% H20/100% MeCN to 9.0 min, Hold at 0% H20/100% Acetonitrile from 9.0 to 10.0 min. Flow: 25 mL/min.

QC Conditions

Column: Waters Atlantis dC18 4.6×50, 5 u; Mobile phase A: 0.05% TFA in water (v/v); Mobile phase B: 0.05% TFA in acetonitrile (v/v); Gradient: 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; retention time=1.85 minutes; mass observed=758.405

6-amino-N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)hexanamide (I-ag-1)

amino]-6-oxohexyl}carbamate (I-y-1) (1200 mg, 0.63 mmol) was dissolved in methanol (30 mL). The solution was then passed through the H-cube using a 10% palladium on carbon (small cartridge) using the following parameters (temperature=50° C., flow rate=1.0 mL/min., pressure=Full H₂ (1 bar)). The solution was collected. A sample was removed and the UPLC showed starting material remaining. The reaction was passed through the H-cube a second time using the above parameters. The collected solution was concentrated under

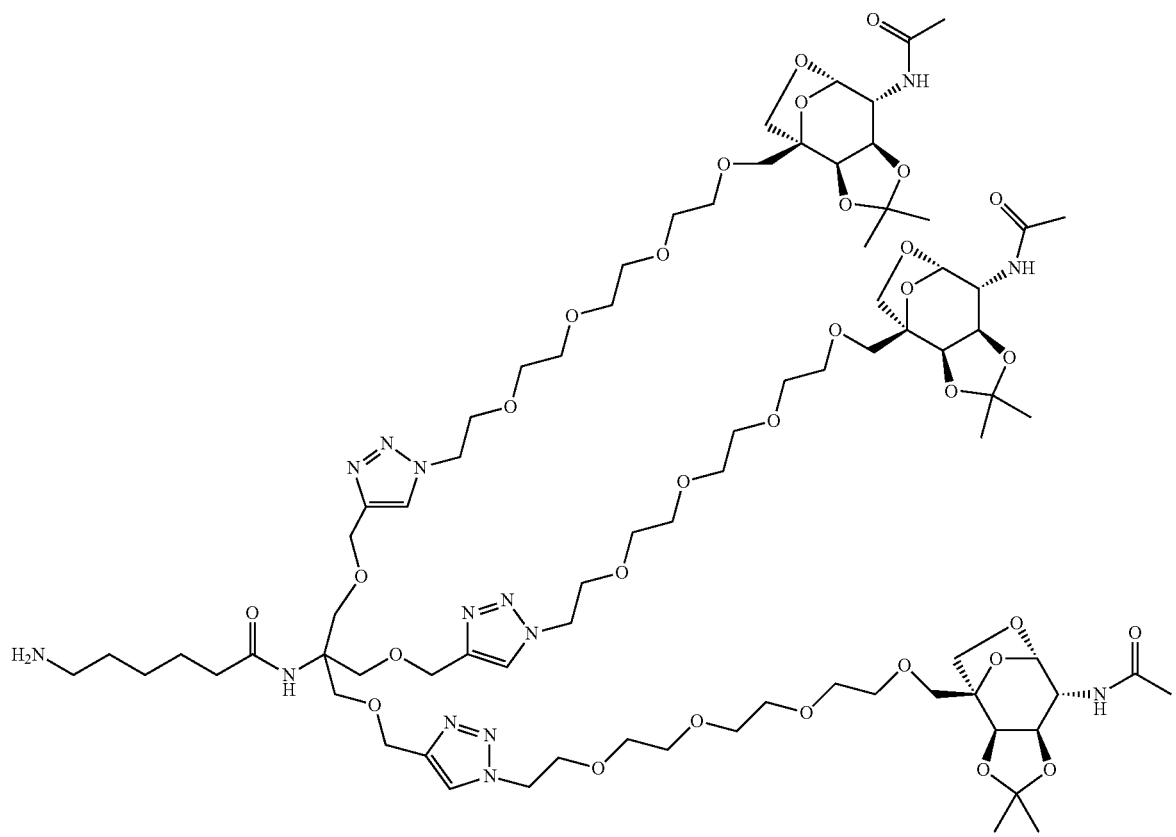 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)CCCCCN)nn3)(O2)[C@@H]2OC(C)(C)O[C@H]12]

benzyl {6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)

reduced pressure yielding the title compound as white foam (1039 mg, 93%). Method C: 1.5 minute run LRMS [½M=886]. ¹H NMR (METHANOL-$d_4$) δ: 7.99 (s, 3H), 5.23 (d, J=1.6 Hz, 3H), 4.45-4.62 (m, 12H), 4.29 (d, J=5.9 Hz, 3H), 4.16 (t, J=6.4 Hz, 3H), 3.87-3.98 (m, 12H), 3.73-3.85 (m, 15H), 3.54-3.70 (m, 36H), 2.87 (t, J=7.6 Hz, 2H), 2.20 (t, J=7.2 Hz, 2H), 1.98 (s, 9H), 1.53-1.69 (m, 4H), 1.48 (s, 9H), 1.34-1.41 (m, 2H), 1.33 (s, 9H)

N-{6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}-6-(pyridin-2-yldisulfanyl)hexanamide (I-ag-2)

before being added to 1-{[6-(pyridin-2-yldisulfanyl)hexanoyl]oxy}pyrrolidine-2,5-dione (I-s-1) (25.2 mg, 0.0711 mmol) and the reaction was then heated to room temperature for 16 hours. After 16 hours, the reaction was diluted with water (15 mL) and brine (5 mL) and extracted three times with dichloromethane (20 mL). The combined organic layers were washed with water (20 mL), brine (20 mL), dried over magnesium sulfate, filtered and concentrated under reduced pressure. The crude material was purified using the CombiFlash Rf (RediSep 12 g silica gel column) and eluting with a gra-

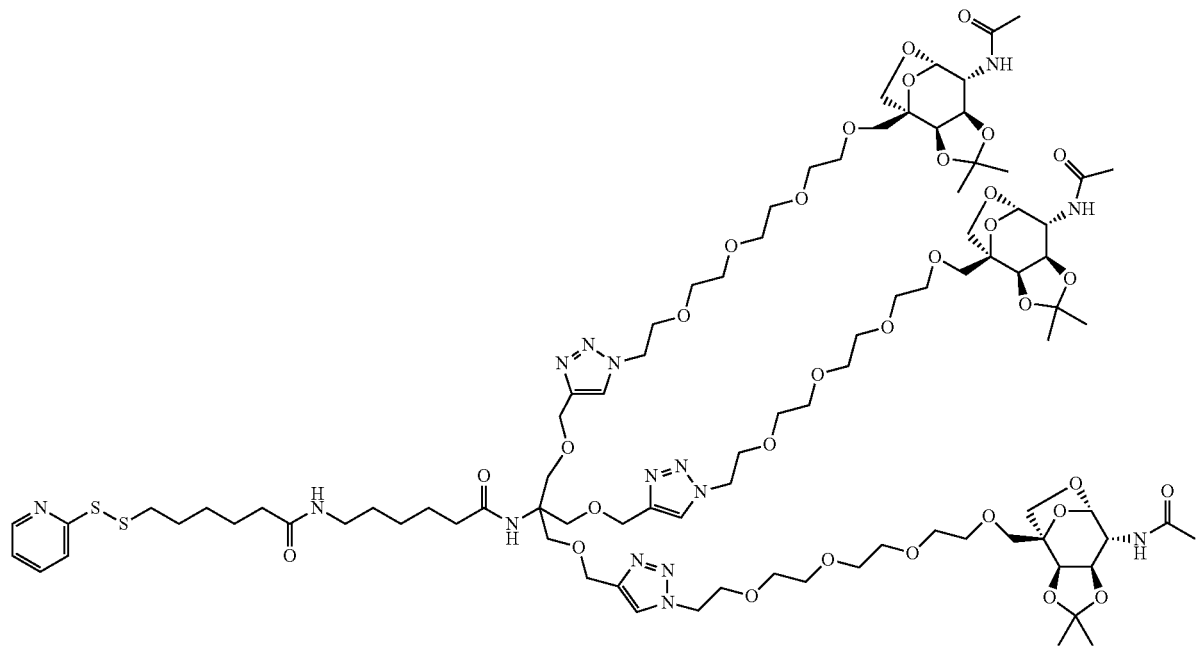 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)CCCCCNC(=O)CCCCCSSc4ccccn4)nn3)(O2)[C@@H]2OC(C)(C)O[C@H]12]

To a solution of 6-amino-N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)hexanamide (I-ag-1) (105.0 mg, 0.0593 mmol) in N,N-dimethylformamide (0.5 mL) and tetrahydrofuran (0.5 mL) was added N,N-diisopropylethylamine (0.031 mL, 0.178 mmol) and was allowed to stir for 10 minutes dient of 0-20% methanol/dichloromethane yielding the title compound (59.6 mg, 50%). Method C: MassLynx\Acid_3.0 Min.olp-LRMS [½M+1=1006]. $^1$H NMR (METHANOL-$d_4$) δ: 8.39 (d, J=4.7 Hz, 1H), 7.98 (s, 3H), 7.83-7.87 (m, 1H), 7.77-7.83 (m, 1H), 7.21 (t, J=5.9 Hz, 1H), 5.23 (d, J=1.6 Hz, 3H), 4.50-4.64 (m, 12H), 4.29 (d, J=5.9 Hz, 3H), 4.16 (t, J=6.4 Hz, 3H), 3.87-3.96 (m, 12H), 3.84 (d, J=7.8 Hz, 3H), 3.71-3.79 (m, 15H), 3.54-3.70 (m, 31H), 3.18-3.28 (m, 2H), 3.13 (q, J=6.5 Hz, 2H), 2.82 (t, J=7.2 Hz, 2H), 2.12-2.23 (m, 4H), 1.98 (s, 9H), 1.71 (quin, J=7.3 Hz, 2H), 1.51-1.64 (m, 6H), 1.44-1.51 (m, 11H), 1.28-1.34 (m, 11H)

N-{6-[(1,3-bis[(1-{1-[(1S,2R,3R,4R,5S)-4-(acety-lamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}-6-(pyridin-2-yldisulfanyl)hexanamide (54)

Purification Conditions:

The residue was dissolved in dimethyl sulfoxide (1 mL) and purified by reversed-phase HPLC Column: Waters Sunfire C18 19×100, 5 u; Mobile phase A: 0.05% TFA in water (v/v); Mobile phase B: 0.05% TFA in acetonitrile (v/v); Gradient: 80.0% H20/20.0% Acetonitrile linear to 70% H20/30% Acetonitrile in 10.5 min to 0% H20/100% MeCN to 11.0 min, Hold at 0% H20/100% Acetonitrile from 11.0 to 12.0 min. Flow: 25 mL/min.

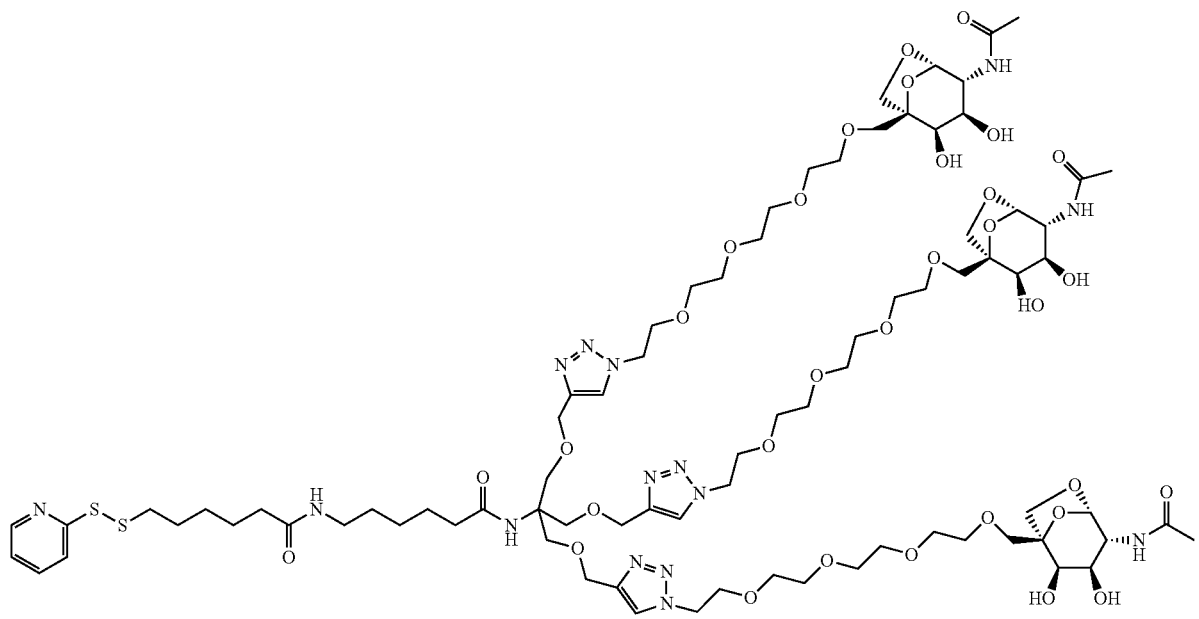 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)CCCCCSSc4ccccn4)nn3)(O2)[C@H](O)[C@@H]1O]

A solution of N-{6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}-6-(pyridin-2-yldisulfanyl)hexanamide (I-ag-2) (59 mg, 0.029 mmol) in acetic acid (4 mL), methanol (1 mL) and water (1 mL) was heated to 70° C. for 24 hours. After 24 hours, the reaction was cooled to room temperature and concentrated under reduced pressure. The crude material was diluted with toluene and concentrated under reduced pressure. The crude material was diluted with toluene a second time and concentrated under reduced pressure yielding the crude title compound (50.5 mg, 91%). The crude material was purified using reverse-phase chromatography using the conditions below and yielding the title compound as a gum (25.2 mg, 45%)

QC Conditions:

Column: Waters Atlantis dC18 4.6×50, 5 u; Mobile phase A: 0.05% TFA in water (v/v); Mobile phase B: 0.05% TFA in acetonitrile (v/v); 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=1.96 minutes; mass observed=946.5137. Method C: MassLynx\Acid_3.0 Min.olp-LRMS [½M+1=946]. $^1$H NMR (METHANOL-$d_4$) δ: 8.45 (d, J=5.1 Hz, 1H), 8.01 (s, 3H), 7.94 (d, J=3.1 Hz, 2H), 7.29-7.36 (m, 1H), 5.21 (s, 3H), 4.57-4.62 (m, 6H), 4.57 (s, 6H), 3.92-4.00 (m, 6H), 3.89 (dd, J=10.7, 4.9 Hz, 9H), 3.74-3.80 (m, 9H), 3.71 (dd, J=10.1, 4.3 Hz, 3H), 3.53-3.68 (m, 42H), 3.13 (t, J=6.8 Hz, 2H), 2.85 (t, J=7.2 Hz, 2H), 2.17 (t, J=7.2 Hz, 4H), 1.99 (s, 9H), 1.71 (quin, J=7.4 Hz, 2H), 1.52-1.64 (m, 4H), 1.45 (td, J=15.0, 7.8 Hz, 4H), 1.26-1.37 (m, 2H)

2-(pyridin-2-yldisulfanyl)ethyl {6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}carbamate (I-ag-3)

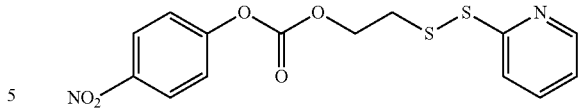

(see European Journal of Medicinal Chemistry, 82, 355-362; 2014, 18.0 mg, 0.051 mmol) room temperature 16 hours. After 16 hours, the reaction mixture was concentrated under reduced pressure. The crude material was purified using the

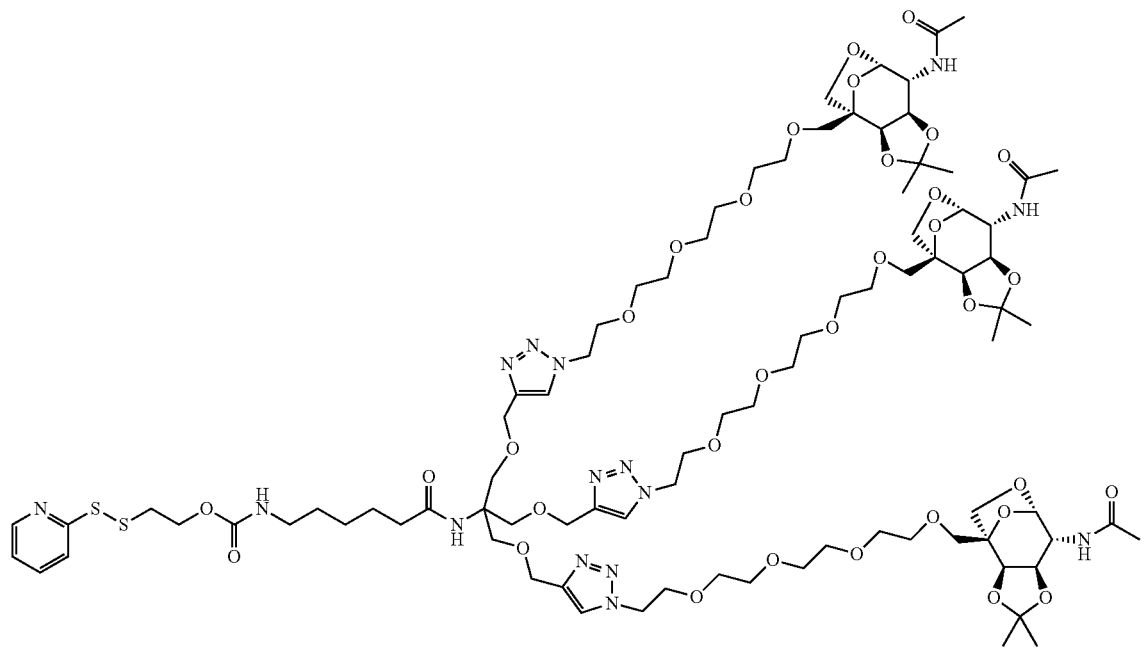 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)CCCCCNC(=O)OCCSSc4ccccn4)nn3)(O2)[C@@H]2OC(C)(C)O[C@H]12]

To a solution of 6-amino-N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)hexanamide (I-ag-1) (61.4 mg, 0.0347 mmol) in N,N-dimethylformamide (0.3 mL) and tetrahydrofuran (0.3 mL) was added N,N-diisopropylethylamine (0.0241 mL, 0.139 mmol) and 4-nitrophenyl 2-(pyridin-2-yldisulfanyl)ethyl carbonate CombiFlash Rf (RediSep 4 g Gold silica gel column) and eluting with a gradient of 0-20% methanol/dichloromethane yielding the title compound as a gum (57.4 mg, None, 83%). Method C: MassLynx\Acid_3.0 Min.olp-LRMS [½M+1=993]. $^1$H NMR (METHANOL-$d_4$) δ: 8.40 (d, J=4.3 Hz, 1H), 7.98 (s, 3H), 7.83-7.89 (m, 1H), 7.75-7.83 (m, 1H), 7.15-7.25 (m, 1H), 5.22 (d, J=1.2 Hz, 3H), 4.51-4.64 (m, 12H), 4.29 (d, J=5.9 Hz, 3H), 4.23 (t, J=6.2 Hz, 2H), 4.15 (t, J=6.4 Hz, 3H), 3.86-3.97 (m, 12H), 3.83 (d, J=7.8 Hz, 3H), 3.72-3.79 (m, 12H), 3.53-3.69 (m, 36H), 3.05 (t, J=5.7 Hz, 4H), 2.17 (t, J=7.0 Hz, 2H), 1.98 (s, 9H), 1.51-1.61 (m, 2H), 1.48 (s, 11H), 1.33 (s, 11H)

2-(pyridin-2-yldisulfanyl)ethyl {6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}carbamate (55)

acetonitrile (v/v); 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=1.91 minutes; mass observed=933.4313. Method C: MassLynx\Acid_3.0 Min.olp-LRMS [½M+1=933]. $^1$H NMR (METHANOL-d$_4$) δ: 8.46 (d, J=4.7 Hz, 1H), 8.01 (s, 3H), 7.86-7.97 (m, 2H), 7.32 (t, J=5.3 Hz, 1H), 5.21 (s, 3H), 4.55-4.62 (m, 12H), 4.24 (t, J=6.0 Hz, 2H), 3.92-3.99 (m, 6H), 3.85-3.92 (m, 9H), 3.74-3.79 (m, 9H), 3.71 (dd, J=9.8, 4.3 Hz, 3H), 3.52-3.68 (m, 42H), 2.99-3.15

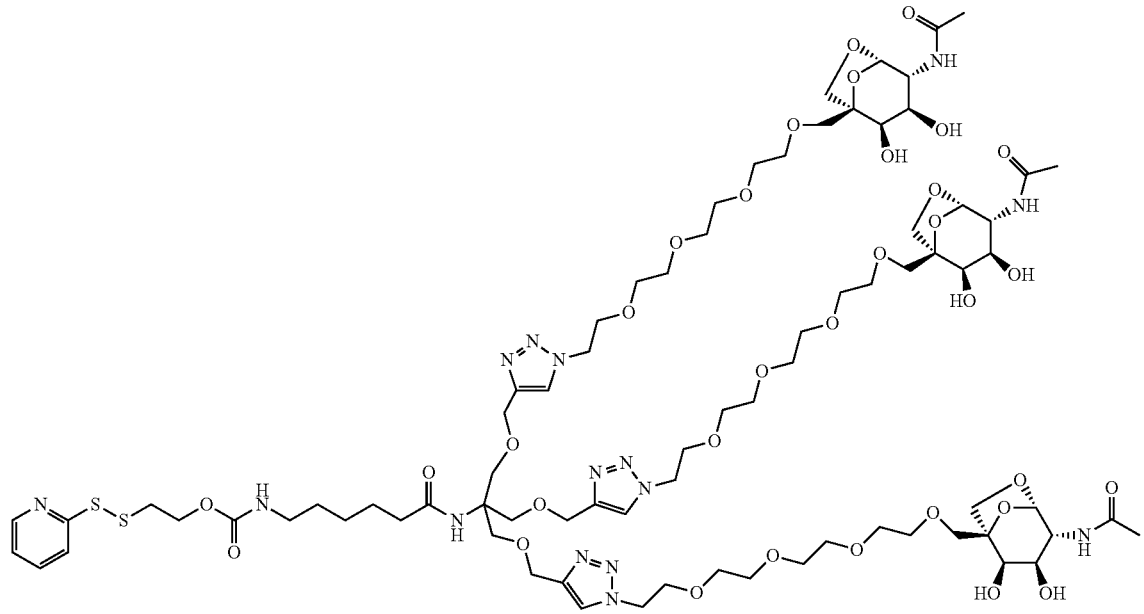 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)OCCSSc4ccccn4)nn3)(O2)[C@H](O)[C@@H]1O]

A solution of 2-(pyridin-2-yldisulfanyl)ethyl {6-[(1,3-bis[(1-{1-[(1 S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1 S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}carbamate (I-ag-3) (57.4 mg, 0.0289 mmol) in acetic acid (4.0 mL), methanol (1.0 mL) and water (1.0 mL) was heated to 70° C. for 24 hours. After 24 hours, the reaction was cooled to room temperature and concentrated under reduced pressure. The crude material was diluted with toluene and concentrated under reduced pressure. The crude material was purified using reverse-phase chromatography using the conditions below yielding the title compound as a gum (29.8 mg, 55%)
Purification Conditions:
The residue was dissolved in dimethyl sulfoxide (1 mL) and purified by reversed-phase HPLC Column: Waters Sunfire C18 19×100, 5 u; Mobile phase A: 0.05% TFA in water (v/v); Mobile phase B: 0.05% TFA in acetonitrile (v/v); Gradient: 80.0% H20/20.0% Acetonitrile linear to 70% H20/30% Acetonitrile in 10.5 min to 0% H20/100% MeCN to 11.0 min, Hold at 0% H20/100% Acetonitrile from 11.0 to 12.0 min. Flow: 25 mL/min.
QC Conditions:
Column: Waters Atlantis dC18 4.6×50, 5 u; Mobile phase A: 0.05% TFA in water (v/v); Mobile phase B: 0.05% TFA in (m, 4H), 2.17 (t, J=7.2 Hz, 2H), 1.99 (s, 9H), 1.56 (quin, J=7.4 Hz, 2H), 1.42-1.50 (m, 2H), 1.24-1.38 (m, 2H)

1-{[6-(4,4,5,5-tetramethyl-1,3,2-dioxaborolan-2-yl)hexanoyl]oxy}pyrrolidine-2,5-dione (I-ah-1)

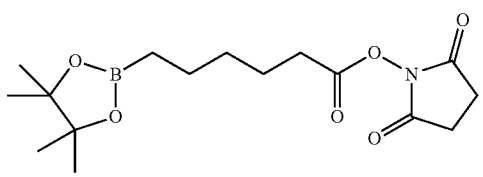 [SMILES: CC1(C)OB(CCCCCC(=O)ON2C(=O)CCC2=O)OC1(C)C]

A solution of chlorotris(Triphenylphosphine)Rhodium (I), Wilkinson's catalyst (39.7 mg, 0.0429 mmol) in dichloromethane (5.0 mL) purged with nitrogen for 10 minutes before the drop wise addition of 4,4,5,5-tetramethyl-1,3,2-dioxaborolane (299 mg, 2.34 mmol, 0.340 mL). The reaction was allowed to stir for 10 minutes at room temperature. 2,5-dioxopyrrolidin-1-yl hex-5-enoate

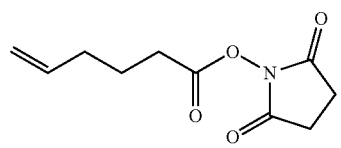

(see Journal of the American Chemical Society, 132(35), 12197-12199; 2010, 412 mg, 1.95 mmol) was dissolved in dichloromethane (1.0 mL) and added drop wise. The reaction was allowed to stir for 18 hours at room temperature. The following morning, the reaction was diluted with dichloromethane and washed with water. The organic layer was dried over magnesium sulfate, filtered and concentrated under reduced pressure. The crude material was purified using the CombiFlash Rf (RediSep 24 g Gold silica gel column) and eluting with a gradient of 0-100% ethyl acetate/heptane yielding crude title compound (366 mg). The crude title compound was purified using the CombiFlash Rf (RediSep 24 g gold silica gel column) and eluting with a gradient of 0-100% ethyl acetate/heptane yielding the title compound as an oil (271.0 mg, None, 41.0%). $^1$H NMR (METHANOL-$d_4$) δ: 2.83 (s, 4H), 2.61 (t, J=7.4 Hz, 2H), 1.71 (quin, J=7.1 Hz, 2H), 1.38-1.50 (m, 4H), 1.24 (s, 12H), 0.75 (t, J=6.8 Hz, 2H).

N-{6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}-6-(4,4,5,5-tetramethyl-1,3,2-dioxaborolan-2-yl)hexanamide (I-ag-4)

To a solution of 6-amino-N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)hexanamide (I-ag-1) (200 mg, 0.113 mmol) in N,N-dimethylformamide (0.6 mL) and tetrahydrofuran (0.6 mL) was added N,N-diisopropylethylamine (0.0786 mL, 0.451 mmol) followed by the addition 1-{[6-(4,4,5,5-tetramethyl-1,3,2-dioxaborolan-2-yl)hexanoyl]oxy}pyrrolidine-2,5-dione (I-ah-1) (57.4 mg, 0.169 mmol) and the reaction was allowed to stir at room temperature for 24 hours. After 24 hours, the reaction was concentrated under reduced pressure. The crude material was purified using the CombiFlash Rf (RediSep 12 g gold silica gel column) and eluting with a gradient of 0-20% methanol/dichloromethane yielding the title compound as a gum (209.0 mg, None, 93%). Method C: 3 minute run LRMS [½M=998]. $^1$H NMR (METHANOL-$d_4$) δ: 7.98 (s, 3H), 5.23 (d, J=1.6 Hz, 3H), 4.52-4.62 (m, 12H), 4.29 (d, J=5.9 Hz, 3H), 4.16 (t, J=6.4 Hz, 3H), 3.87-3.97 (m, 12H), 3.84 (d, J=8.2 Hz, 3H), 3.72-3.79 (m, 12H), 3.54-3.69 (m, 36H), 3.13 (q, J=6.6 Hz, 2H), 2.16 (q, J=7.3 Hz, 4H), 1.98 (s, 9H), 1.52-1.66 (m, 4H), 1.44-1.51 (m, 11H), 1.35-1.43 (m, 2H), 1.27-1.35 (m, 13H), 1.18-1.25 (m, 12H), 0.73 (t, J=7.6 Hz, 2H)

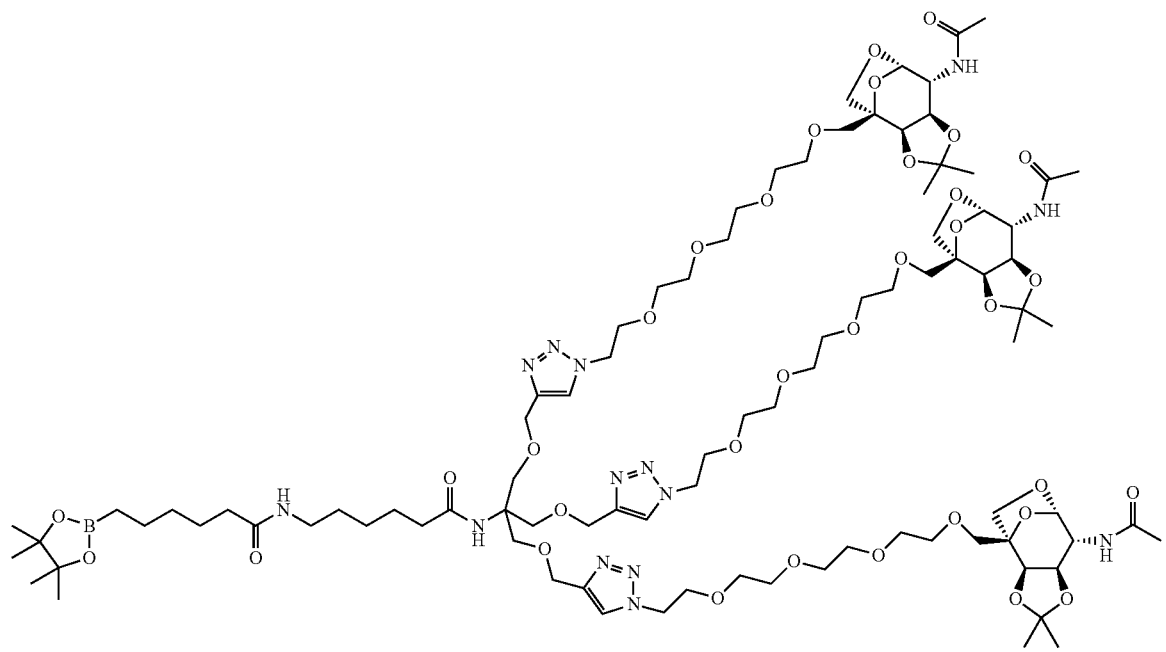 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)CCCCCNC(=O)CCCCCB4OC(C)(C)C(C)(C)O4)nn3)(O2)[C@@H]2OC(C)(C)O[C@H]12]

N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}-6-(4,4,5,5-tetramethyl-1,3,2-dioxaborolan-2-yl)hexanamide (56)

QC Conditions
Column: Waters Atlantis dC18 4.6×50, 5 u; Mobile phase A: 0.05% TFA in water (v/v); Mobile phase B: 0.05% TFA in acetonitrile (v/v); Gradient: 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=2 minutes; Mass observed=938.9628). $^1$H NMR (METHANOL-$d_4$) δ: 8.01 (s, 3H), 5.21 (s, 3H), 4.51-4.66 (m, 12H), 3.95 (dd, J=9.4, 5.9 Hz, 6H), 3.89 (dd, J=11.7, 4.7 Hz, 9H), 3.74-3.81 (m, 9H), 3.71

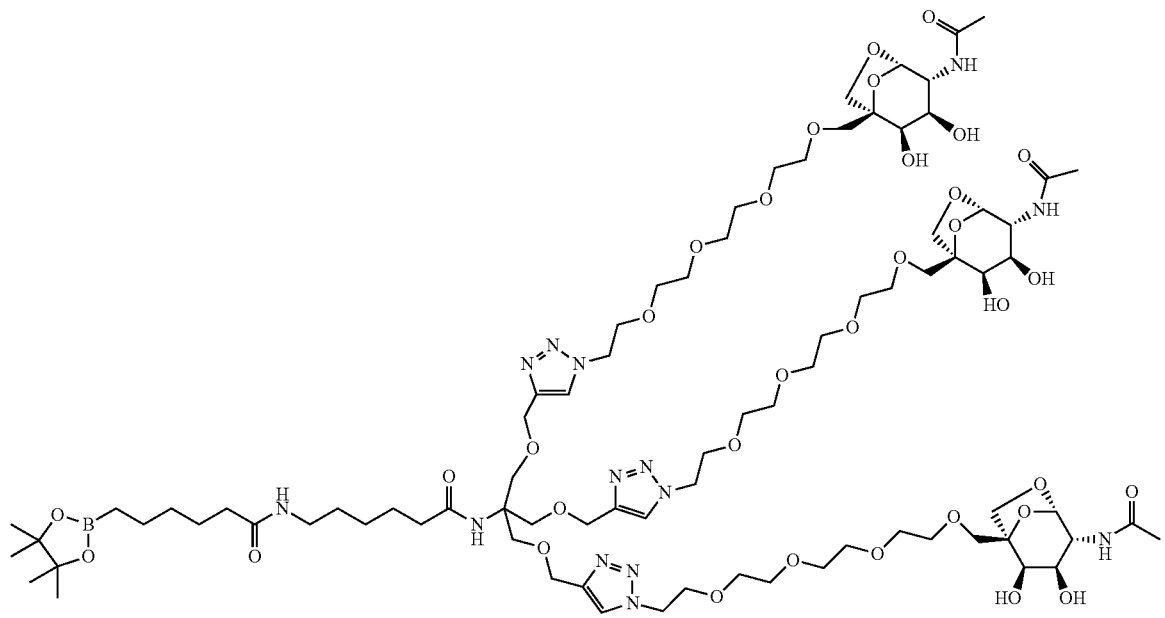 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)CCCCCB4OC(C)(C)C(C)(C)O4)nn3)(O2)[C@H](O)[C@@H]1O]

A solution of N-{6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}-6-(4,4,5,5-tetramethyl-1,3,2-dioxaborolan-2-yl)hexanamide (I-ag-4) (104.0 mg, 0.0521 mmol) in acetic acid (4 mL), methanol (1 mL) and water (1 mL) was heated to 70° C. for 24 hours. After 24 hours, the reaction was cooled to room temperature and concentrated under reduced pressure. The crude material was diluted with toluene and concentrated under reduced pressure. The crude material was diluted with toluene a second time and concentrated under reduced pressure yielding crude title compound (112.0 mg, 115%). A portion of the crude title compound (52.7 mg) was purified using reverse-phase chromatography yielding the title compound as a gum (18.2 mg, 19%)

Purification Conditions
The residue was dissolved in dimethyl sulfoxide (1 mL) and purified by reversed-phase HPLC Column: Waters Sunfire C18 19×100, 5 u; Mobile phase A: 0.05% TFA in water (v/v); Mobile phase B: 0.05% TFA in acetonitrile (v/v); Gradient: 80.0% H20/20.0% Acetonitrile linear to 65% H20/35% Acetonitrile in 8.5 min to 0% H20/100% MeCN to 9.0 min, Hold at 0% H20/100% Acetonitrile from 9.0 to 10.0 min. Flow: 25 mL/min.

(dd, J=9.8, 4.3 Hz, 3H), 3.52-3.68 (m, 42H), 3.13 (t, J=6.8 Hz, 2H), 2.17 (q, J=7.0 Hz, 4H), 1.99 (s, 9H), 1.53-1.66 (m, 4H), 1.45-1.52 (m, 2H), 1.36-1.44 (m, 2H), 1.27-1.35 (m, 4H), 1.23 (s, 12H), 0.73 (t, J=7.6 Hz, 2H)

ethyl 7-[(1,3-dihydroxypropan-2-yl)amino]-7-oxoheptanoate (I-ai-1)

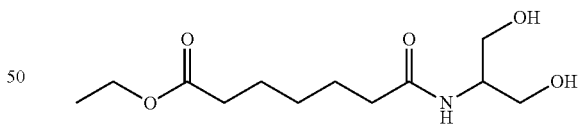

To a solution of ethyl 7-[(2,5-dioxopyrrolidin-1-yl)oxy]-7-oxoheptanoate (I-z-1) (228.0 mg, 0.799 mmol) in N,N-dimethylformamide (1.0 mL) was added N,N-diisopropylethylamine (0.557 mL, 3.20 mmol) and was allowed to stir for 10 minutes before the addition of 2-aminopropane-1,3-diol (72.8 mg, 0.799 mmol) and the reaction was stirred at room temperature for 72 hours. After 72 hours, the reaction was diluted with water and extracted 3 times with dichloromethane. The combined organic layers were washed with brine, dried over magnesium sulfate, filtered and concentrated under reduced pressure yielding crude title compound (89.0 mg, None, 43%). The aqueous layer was concentrated under reduced pressure. The crude concentrated aqueous layer was diluted with methanol (5 mL) and dichloromethane (10 mL). The mixture was decanted and combined with crude title compound from the first extraction. The solution was concentrated under reduced pressure. The combined crude material was purified using the CombiFlash Rf (RediSep 12 g silica gel column) and eluting with a gradient of 0-20% methanol/dichloromethane yielding the title compound (183.0 mg, 88%). Method C: 3 minute run LRMS [M+1=262]. $^1$H NMR (METHANOL-d$_4$) δ: 4.11 (q, J=7.2 Hz, 2H), 3.83-3.99 (m, 1H), 3.60 (d, J=5.5 Hz, 4H), 2.31 (t, J=7.2 Hz, 2H), 2.23 (t, J=7.4 Hz, 2H), 1.63 (quin, J=7.5 Hz, 4H), 1.30-1.45 (m, 2H), 1.24 (t, J=7.0 Hz, 3H)

ethyl 7-[(2,2-dimethyl-1,3-dioxan-5-yl)amino]-7-oxoheptanoate (I-aj-1)

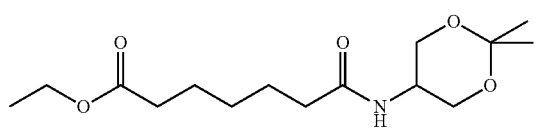 [SMILES: CCOC(=O)CCCCCC(=O)NC1COC(C)(C)OC1]

To a solution of ethyl 7-[(1,3-dihydroxypropan-2-yl)amino]-7-oxoheptanoate (I-ai-1) (180.0 mg, 0.689 mmol) in N,N-dimethylformamide (2 mL) was added 2,2-dimethoxypropane (0.53 mL, 4.13 mmol) followed by (1S)-(+)-10-Camphorsulfonic acid (64.0 mg, 0.276 mmol). The reaction was heated to 70° C. for 72 hours. After 72 hours, the reaction was cooled to room temperature and partitioned between water (20 mL) and ethyl acetate (10 mL). The layers were extracted and the layers were separated. The aqueous layer was washed two additional times with ethyl acetate (10 mL). The combined organic layers were washed with water, brine, dried over sodium sulfate, filtered and concentrated under reduced pressure yielding the crude title compound (94.0 mg, None, 45%).

7-[(2,2-dimethyl-1,3-dioxan-5-yl)amino]-7-oxoheptanoic acid (I-ak-1)

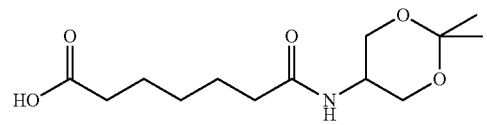 [SMILES: CC1(C)OCC(NC(=O)CCCCCC(=O)O)CO1]

To a solution of ethyl 7-[(2,2-dimethyl-1,3-dioxan-5-yl)amino]-7-oxoheptanoate (I-aj-1) (94.0 mg, 0.31 mmol) in ethanol (5 mL) was added 1.0M sodium hydroxide aqueous (1.5 mL, 1.5 mmol) and the reaction was allowed to stir at room temperature overnight. The following morning, the reaction was concentrated under reduced pressure. The resulting crude material was diluted with 1N hydrochloric acid (3.0 mL) and ethyl acetate. The layers were separated and the organic layer was extracted two additional times with ethyl acetate. The combined organic layers were washed with brine, dried over sodium sulfate, filtered and concentrated under reduced pressure yielding the crude title compound (29.4 mg, None, 34%).

N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}-N'-(1,3-dihydroxypropan-2-yl)heptanediamide (57)

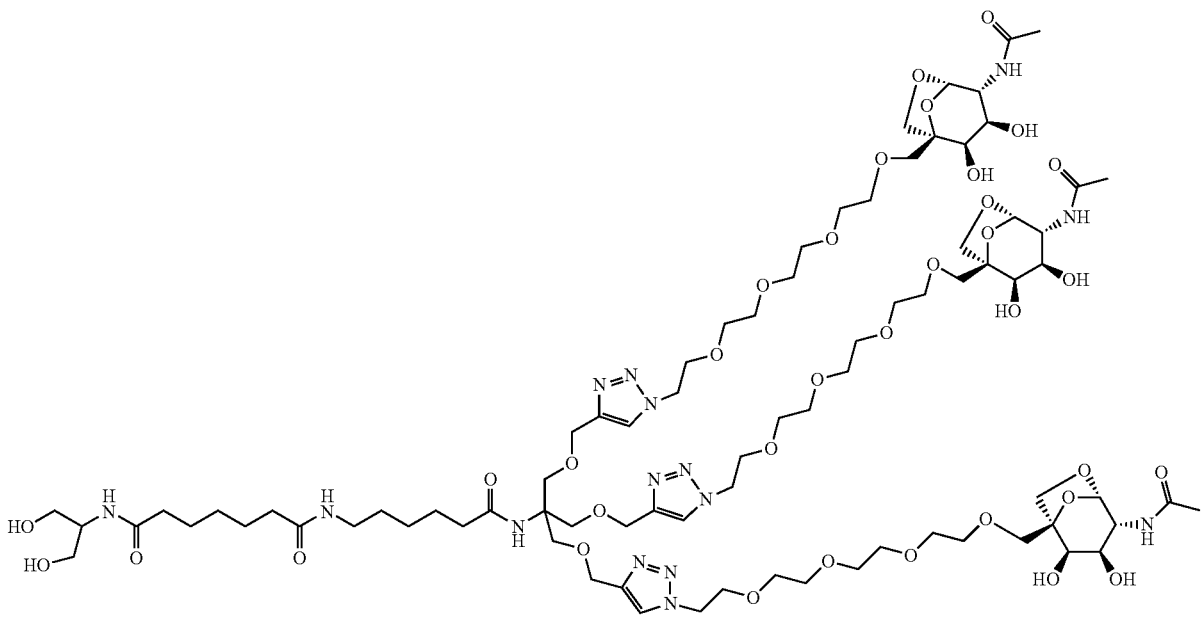 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)CCCCCC(=O)NC(CO)CO)nn3)(O2)[C@H](O)[C@@H]1O]

To a solution of 7-[(2,2-dimethyl-1,3-dioxan-5-yl)amino]-7-oxoheptanoic acid (I-ak-1) (18.8 mg, 0.0688 mmol) in N,N-dimethylformamide (0.3 mL) and tetrahydrofuran (0.3 mL) was added 1-Hydroxybenzotriazole (10.3 mg, 0.0762 mmol) and N-(3-dimethylaminopropyl)-N'-ethylcarbodiimide hydrochloride (14.9 mg, 0.0762 mmol) and the reaction was allowed to stir for 1 hour at room temperature. The reaction mixture was added to 6-amino-N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)hexanamide (I-ag-1) (75.0 mg, 0.042 mmol) followed by the addition of N,N-diisopropylethylamine (0.0295 mL, 0.169 mmol) and the reaction was allowed to stir at room temperature for 16 hours. After 16 hours, the reaction was concentrated under reduced pressure. The crude material was dissolved in acetic acid (4.0 mL), methanol (1 mL), and Water (1.0 mL) was heated to 70° C. for 24 hours. After 24 hours, the reaction was cooled to room temperature and concentrated under reduced pressure. The crude material was diluted with toluene and concentrated under reduced pressure yielding crude title compound (175.0 mg, 220%). The crude title compound was purified by revered-phase chromatography using the conditions below yielding the title compound as a gum (10.9 mg, 14%)

Purification Conditions:

The residue was dissolved in dimethyl sulfoxide (1 mL) and purified by reversed-phase HPLC Column: Waters Sunfire C18 19×100, 5 u; Mobile phase A: 0.05% TFA in water (v/v); Mobile phase B: 0.05% TFA in acetonitrile (v/v); Gradient: 85.0% H20/15.0% Acetonitrile linear to 75% H20/25% Acetonitrile in 8.5 min to 0% H20/100% MeCN to 9.0 min, Hold at 0% H20/100% Acetonitrile from 9.0 to 10.0 min. Flow: 25 mL/min.

QC Conditions:

Column: Waters Atlantis dC18 4.6×50, 5 u; Mobile phase A: 0.05% TFA in water (v/v); Mobile phase B: 0.05% TFA in acetonitrile (v/v); 95.0% H20/5.0% Acetonitrile linear to 5% H20/95% Acetonitrile in 4.0 min, Hold at 5% H20/95% Acetonitrile from 4.0 min to 5.0 min. Flow: 2 mL/min.; Retention time=1.53 minutes; mass observed=934.548. Method C: 3 minute run LRMS [M+Na=1889]. $^1$H NMR (METHANOL-d$_4$) δ: 8.00 (s, 3H), 5.21 (s, 3H), 4.52-4.62 (m, 12H), 3.95 (t, J=9.4 Hz, 6H), 3.85-3.91 (m, 9H), 3.74-3.79 (m, 9H), 3.71 (dd, J=10.0, 4.1 Hz, 3H), 3.55-3.67 (m, 47H), 3.12 (t, J=6.7 Hz, 2H), 2.22 (t, J=7.3 Hz, 2H), 2.17 (t, J=7.3 Hz, 4H), 1.98 (s, 9H), 1.58-1.69 (m, 4H), 1.51-1.57 (m, 2H), 1.48 (quin, J=7.2 Hz, 2H), 1.26-1.40 (m, 4H)

6-azido-N-{6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}hexanamide (I-ag-5)

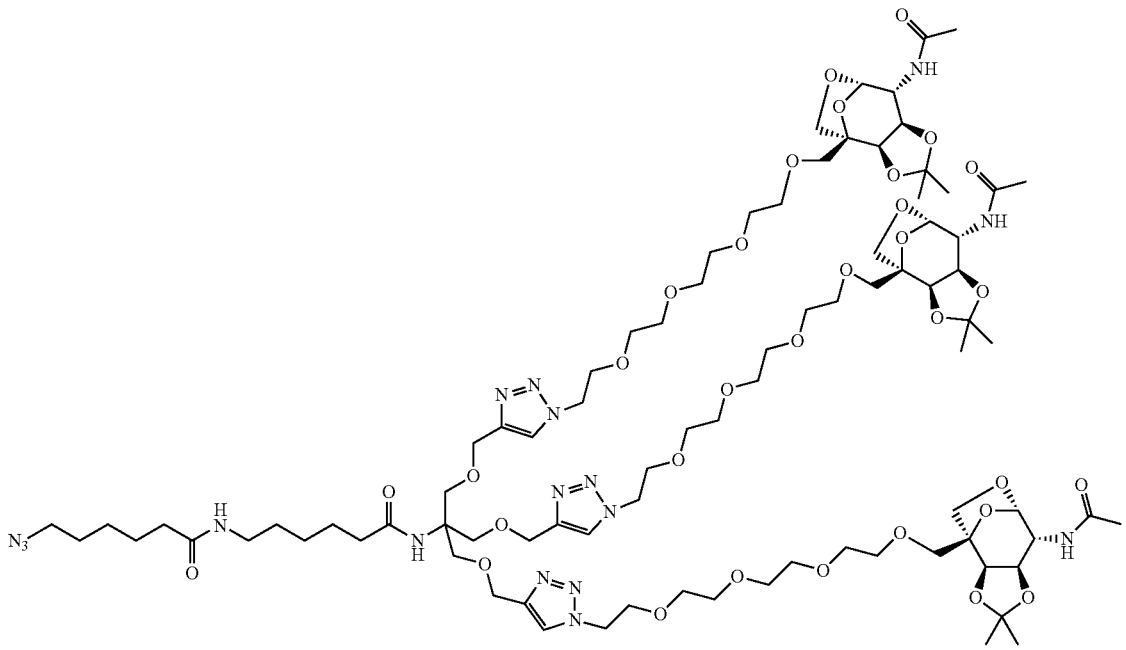 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)CCCCCNC(=O)CCCCCN=[N+]=[N-])nn3)(O2)[C@@H]2OC(C)(C)O[C@H]12]

To a solution of 6-amino-N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)hexanamide (I-ag-1) (300 mg, 0.169 mmol) in N,N-dimethylformamide (0.6 mL) and tetrahydrofuran (0.6 mL) was added N,N-diisopropylethylamine (0.118 mL, 0.677 mmol) and 1-[(6-azidohexanoyl)oxy]pyrrolidine-2,5-dione (56.0 mg, 0.220 mmol). The reaction was allowed to stir at room temperature for 24 hours. After 24 hours, the reaction was concentrated under reduced pressure. The crude reaction mixture was purified using the CombiFlash Rf (RediSep 24 g gold silica gel column) and eluting with a gradient of 0-20% methanol/dichloromethane yielding the title compound as a gum (269 mg, 83%). Method C: 3 minute run LRMS [½M+1=956]. $^1$H NMR (METHANOL-d$_4$) δ: 7.98 (s, 3H), 5.22 (s, 3H), 4.50-4.65 (m, 12H), 4.29 (d, J=5.9 Hz, 3H), 4.16 (t, J=6.5 Hz, 3H), 3.87-3.95 (m, 12H), 3.83 (d, J=7.6 Hz, 3H), 3.73-3.79 (m, 12H), 3.55-3.71 (m, 36H), 3.26-3.30 (m, 2H), 3.14 (q, J=6.5 Hz, 2H), 2.18 (q, J=7.6 Hz, 4H), 1.98 (s, 9H), 1.53-1.68 (m, 6H), 1.45-1.51 (m, 11H), 1.36-1.43 (m, 2H), 1.29-1.36 (m, 11H)

6-azido-N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1 S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}hexanamide (58)

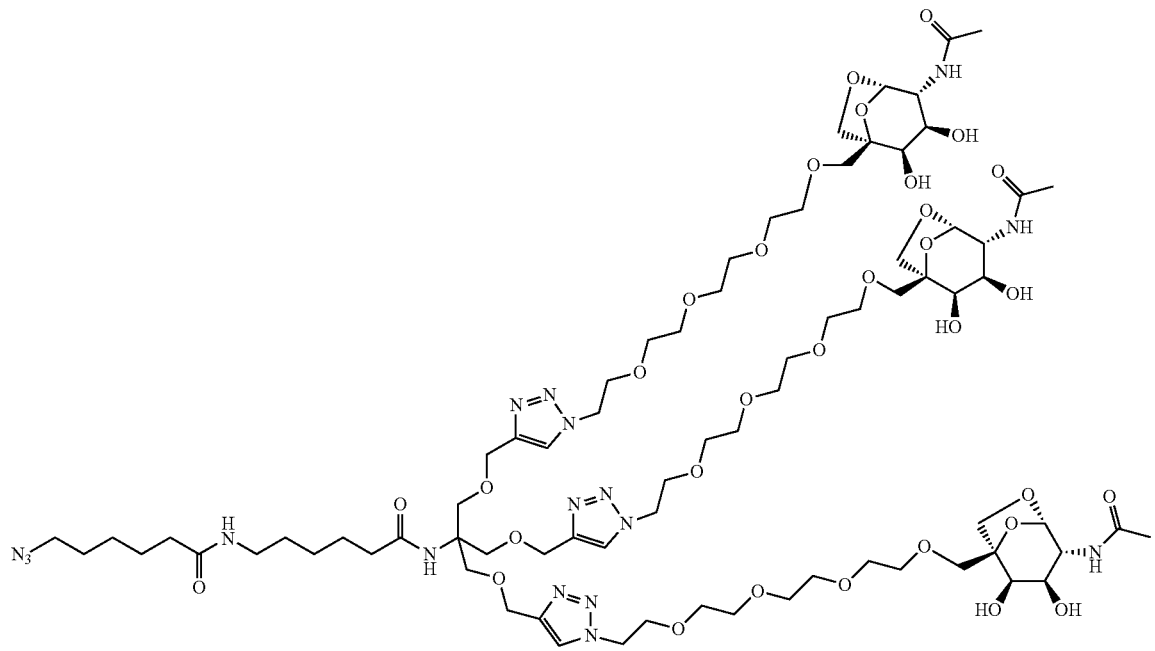 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)CCCCCN=[N+]=[N-])nn3)(O2)[C@H](O)[C@@H]1O]

A solution of 6-azido-N-{6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}hexanamide (I-ag-5) (25.0 mg, 0.013 mmol) in acetic acid (3 mL), methanol (0.75 mL) and water (0.75 mL) was heated to 70° C. for 24 hours. After 24 hours, the reaction was cooled to room temperature and concentrated under reduced pressure. The crude material was diluted with toluene and concentrated under reduced pressure yielding the title compound as a gum (22.7 mg, 97%). Method C: 3 minute run LRMS [M+1=1791]. $^1$H NMR (METHANOL-d$_4$) δ: 7.99 (s, 3H), 5.21 (s, 3H), 4.51-4.66 (m, 12H), 3.92-4.01 (m, 6H), 3.89 (dd, J=10.1, 4.7 Hz, 9H), 3.74-3.81 (m, 9H), 3.71 (dd, J=10.0, 4.1 Hz, 3H), 3.52-3.68 (m, 42H), 3.25-3.30 (m, 2H), 3.08-3.19 (m, 2H), 2.13-2.23 (m, 4H), 1.99 (s, 9H), 1.54-1.69 (m, 6H), 1.49 (dt, J=14.4, 7.2 Hz, 2H), 1.36-1.44 (m, 2H), 1.32 (dd, J=14.8, 6.2 Hz, 2H)

1-{[6-(benzyloxy)hexanoyl]oxy}pyrrolidine-2,5-dione (I-al-1)

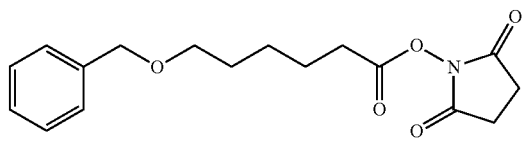 [SMILES: O=C(CCCCCOCc1ccccc1)ON1C(=O)CCC1=O]

To a solution of 6-(benzyloxy)hexanoic acid

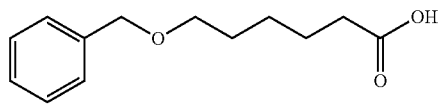 [SMILES: O=C(O)CCCCCOCc1ccccc1]

(see Synlett, (4), 693-697; 2004, 1400.0 mg, 6.298 mmol) in N,N-dimethylformamide (20 mL) was added N-Hydroxysuccinimide (870 mg, 7.56 mmol) followed by N-(3-dimethylaminopropyl)-N'-ethylcarbodimiimide hydrochloride (1480 mg, 7.56 mmol). The reaction was allowed to stir at room temperature overnight. The following morning, the reaction was quenched with water and extracted three times with dichloromethane. The combined organic layers were washed with saturated sodium bicarbonate, brine, dried over sodium sulfate, filtered and concentrated under reduced pressure. The crude material was purified using the CombiFlash Rf (RediSep 40 g gold column) and eluting with a gradient of 0-100% ethyl acetate/heptane yielding the title compound as a gum (715 mg, 36%). Method C: 1.5 minute run LRMS [M+Na=342]. ¹H NMR (METHANOL-d₄) δ: 7.22-7.42 (m, 5H), 4.51 (s, 2H), 3.53 (t, J=6.4 Hz, 2H), 2.85 (s, 4H), 2.65 (t, J=7.4 Hz, 2H), 1.76 (quin, J=7.5 Hz, 2H), 1.61-1.71 (m, 2H), 1.47-1.59 (m, 2H)

6-(benzyloxy)-N-{6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}hexanamide (I-ag-6)

tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)hexanamide (I-ag-1) (200 mg, 0.113 mmol) in N,N-dimethylformamide (0.6 mL) and tetrahydrofuran (0.6 mL) was added N,N-diisopropylethylamine (0.0786 mL, 0.451 mmol) and 1-{[6-(benzyloxy)hexanoyl]oxy}pyrrolidine-2,5-dione (I-al-1)(46.9 mg, 0.147 mmol) and the reaction was allowed to stir at room temperature for 24 hours. After 24 hours, the reaction was concentrated under reduced pressure. The crude material was purified using the CombiFlash Rf (RediSep 12 g gold silica gel column) and eluting with a gradient of 0-20% methanol/dichloromethane yielding the title compound as gum (203 mg, 91%). ¹H NMR (METHANOL-d₄) δ: 7.98 (s, 3H), 7.19-7.38 (m, 5H), 5.23 (d, J=1.2 Hz, 3H), 4.52-4.64 (m, 12H), 4.48 (s, 2H), 4.29 (d,

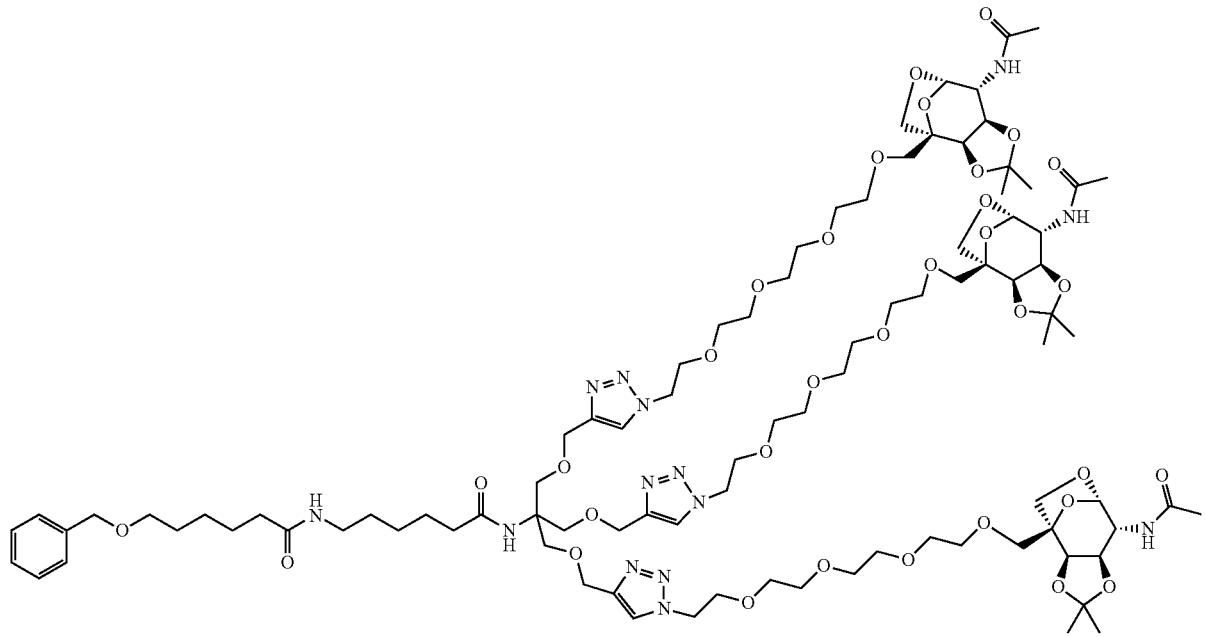 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)CCCCCNC(=O)CCCCCOCc4ccccc4)nn3)(O2)[C@@H]2OC(C)(C)O[C@H]12]

To a solution of 6-amino-N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-

J=5.9 Hz, 3H), 4.15 (t, J=6.4 Hz, 3H), 3.86-3.96 (m, 12H), 3.83 (d, J=7.8 Hz, 3H), 3.72-3.80 (m, 12H), 3.54-3.70 (m, 36H), 3.49 (t, J=6.4 Hz, 2H), 3.08-3.15 (m, 2H), 2.12-2.26 (m, 4H), 1.98 (s, 9H), 1.51-1.68 (m, 6H), 1.48 (s, 11H), 1.37-1.44 (m, 2H), 1.33 (s, 11H)

6-(benzyloxy)-N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}hexanamide (59)

6) (180.0 mg, 0.0911 mmol) in acetic acid (6.0 mL), methanol (1.5 mL) and water (1.5 mL) was heated to 70° C. for 24 hours. After 24 hours, the reaction was cooled to room temperature and concentrated under reduced pressure. The crude material was diluted with toluene and concentrated under reduced pressure. The crude material was diluted with toluene a second time and concentrated under reduced pressure yielding the title compound as a gum (164.0 mg, 97.0%). Method C: 3 minute run LRMS [½M=928]. $^1$H NMR

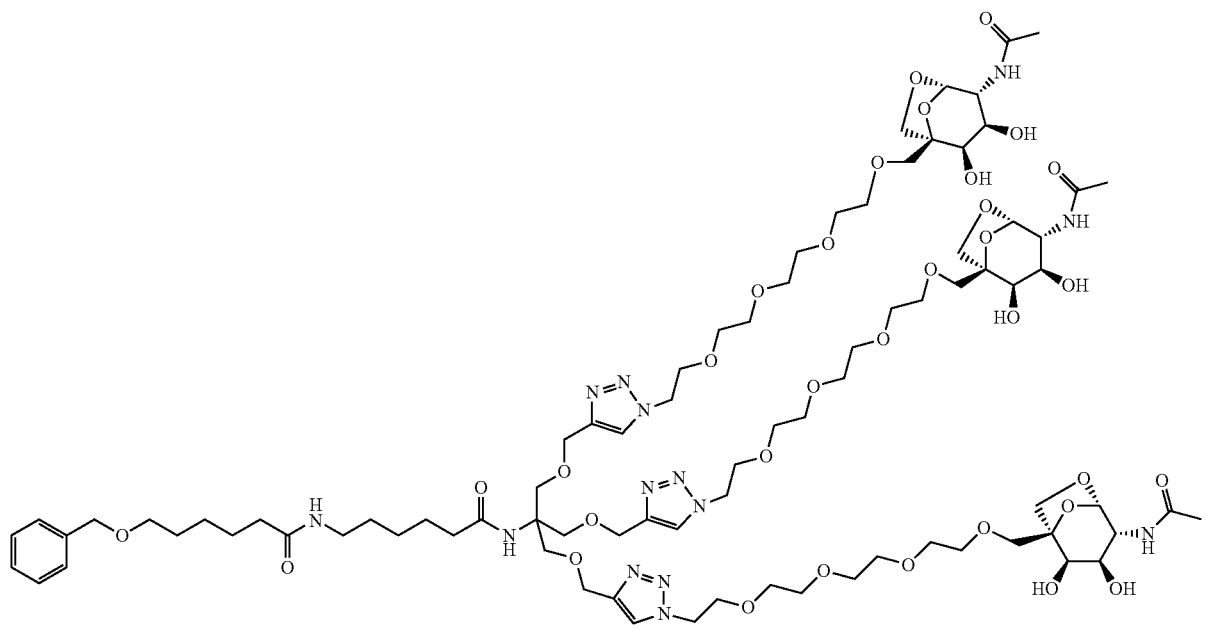 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)CCCCCOCc4ccccc4)nn3)(O2)[C@H](O)[C@@H]1O]

A solution of 6-(benzyloxy)-N-{6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}hexanamide (I-ag- (METHANOL-$d_4$) δ: 7.99 (s, 3H), 7.25-7.39 (m, 5H), 5.21 (s, 3H), 4.52-4.66 (m, 12H), 4.48 (s, 2H), 3.92-3.99 (m, 6H), 3.84-3.91 (m, 9H), 3.74-3.81 (m, 9H), 3.71 (dd, J=9.8, 4.3 Hz, 3H), 3.54-3.67 (m, 42H), 3.49 (t, J=6.4 Hz, 2H), 3.08-3.17 (m, 2H), 2.13-2.22 (m, 4H), 1.99 (s, 9H), 1.51-1.68 (m, 6H), 1.48 (t, J=7.4 Hz, 2H), 1.39 (dt, J=15.3, 7.8 Hz, 2H), 1.26-1.35 (m, 2H)

(1S,2R,3R,4R,5S)-4-(acetylamino)-2-(acetyloxy)-1-
{13-[4-(4,4-bis{[(1-{1-[(1S,2R,3R,4R,5S)-4-(acety-
lamino)-2,3-bis(acetyloxy)-6,8-dioxabicyclo[3.2.1]
oct-1-yl]-2,5,8,11-tetraoxatridecan-13-yl}-1H-1,2,3-
triazol-4-yl)methoxy]methyl}-6,13-dioxo-20-phenyl-
2,19-dioxa-5,12-diazaicos-1-yl)-1H-1,2,3-triazol-1-
yl]-2,5,8,11-tetraoxatridec-1-yl}-6,8-dioxabicyclo
[3.2.1]oct-3-yl acetate (I-am-1)

6-(benzyloxy)-N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}hexanamide (59) (130 mg, 0.07 mmol) was dissolved in (3 mL, 40 mmol) and to which was added acetic anhydride (0.198 mL, 2.10 mmol) at room temperature. The reaction was then heated to 50° C. overnight. The following morning, the reaction was concentrated under reduced pressure. The crude material was purified using the CombiFlash Rf (RediSep 12 g gold silica gel column) and eluting with a gradient of 0-20% methanol/dichloromethane yielding the title compound as a gum (130.0 mg, 88%). Method C: 3 minute run LRMS [½M=1054]. $^1$H NMR (METHANOL-d$_4$) δ: 7.98 (s, 3H), 7.16-7.39 (m, 5H), 5.44 (d, J=4.3 Hz, 3H), 5.32 (s, 3H), 5.10 (dd, J=10.5, 4.3 Hz, 3H), 4.52-4.60 (m, 12H), 4.48 (s, 2H), 4.18 (d, J=10.5 Hz, 3H), 3.99 (d, J=8.2 Hz, 3H), 3.89 (t, J=5.1 Hz, 6H), 3.70-3.81 (m, 12H), 3.52-3.67 (m, 39H), 3.49 (t, J=6.2 Hz, 2H), 3.13 (q, J=6.6 Hz, 2H), 2.13-2.21 (m, 13H), 1.94 (d, J=1.6 Hz, 18H), 1.51-1.68 (m, 6H), 1.45-1.50 (m, 2H), 1.37-1.43 (m, 2H), 1.28-1.35 (m, 2H)

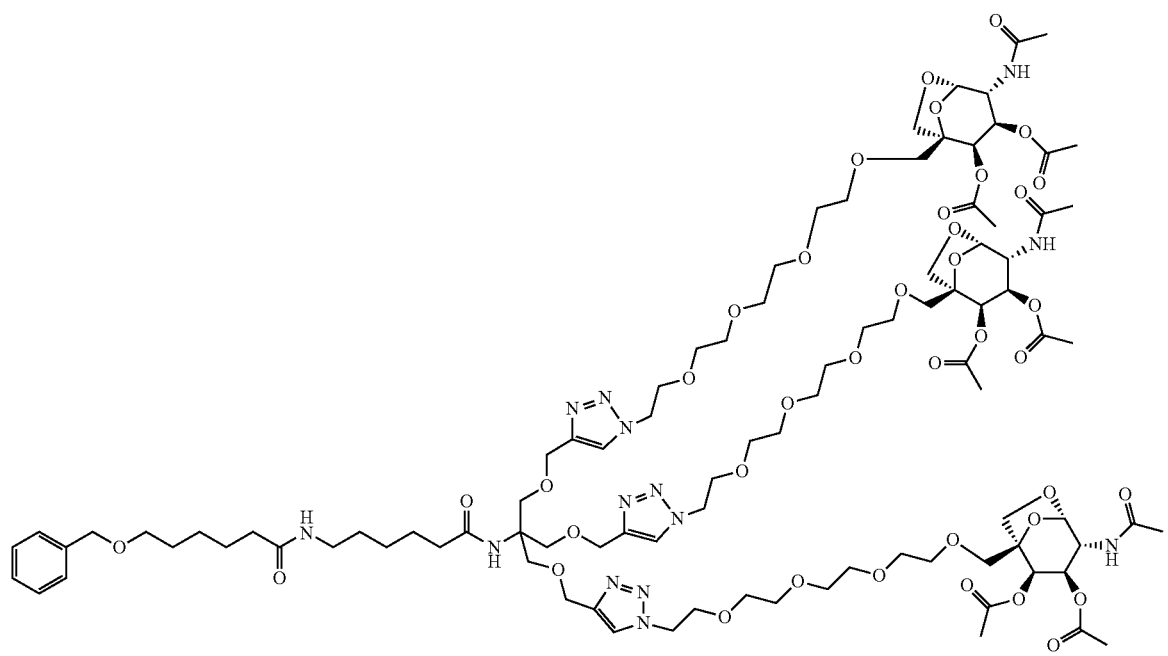 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](OC(C)=O)[C@H]6OC(C)=O)nn4)(COCc4cn(CCOCCOCCOCCOC[C@@]56CO[C@@H](O5)[C@H](NC(C)=O)[C@@H](OC(C)=O)[C@H]6OC(C)=O)nn4)NC(=O)CCCCCNC(=O)CCCCCOCc4ccccc4)nn3)(O2)[C@H](OC(C)=O)[C@@H]1OC(C)=O]

N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}-6-hydroxyhexanamide (I-an-1)

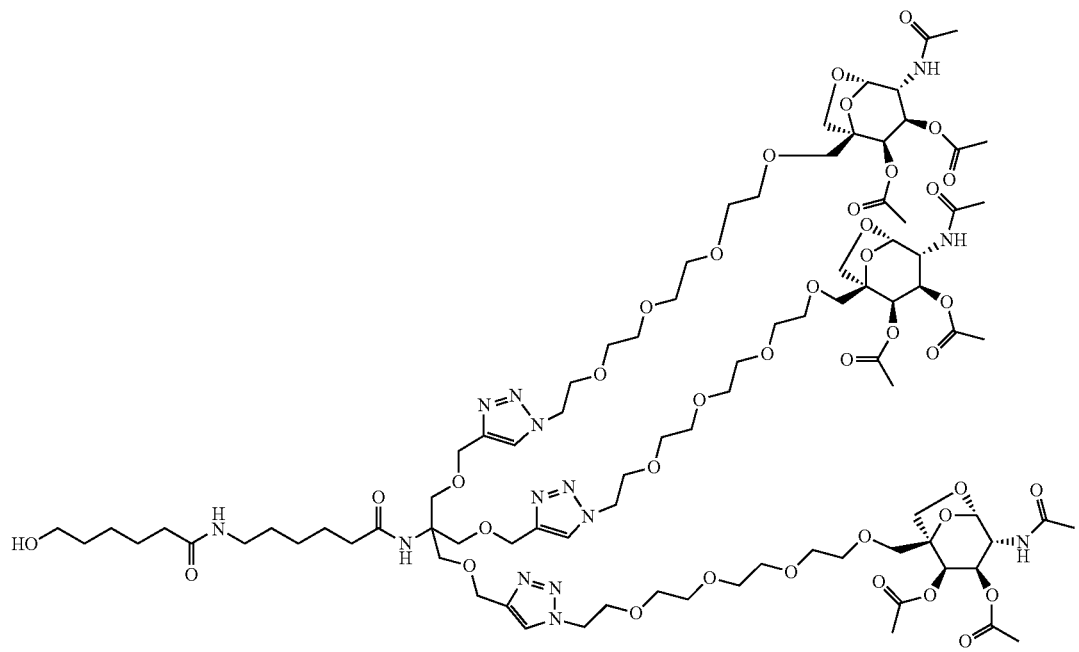 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](OC(C)=O)[C@H]6OC(C)=O)nn4)(COCc4cn(CCOCCOCCOCCOC[C@@]56CO[C@@H](O5)[C@H](NC(C)=O)[C@@H](OC(C)=O)[C@H]6OC(C)=O)nn4)NC(=O)CCCCCNC(=O)CCCCCO)nn3)(O2)[C@H](OC(C)=O)[C@@H]1OC(C)=O]

(1S,2R,3R,4R,5S)-4-(acetylamino)-2-(acetyloxy)-1-{13-[4-(4,4-bis{[(1-{1-[(1S,2R,3R,4R,5S)-4-(acetylamino)-2,3-bis(acetyloxy)-6,8-dioxabicyclo[3.2.1]oct-1-yl]-2,5,8,11-tetraoxatridecan-13-yl}-1H-1,2,3-triazol-4-yl)methoxy]methyl}-6,13-dioxo-20-phenyl-2,19-dioxa-5,12-diazaicos-1-yl)-1H-1,2,3-triazol-1-yl]-2,5,8,11-tetraoxatridec-1-yl}-6,8-dioxabicyclo[3.2.1]oct-3-yl acetate (I-am-1) (110 mg, 0.0522 mmol) was dissolved in methanol (10.0 mL) and the solution was then passed through the H-cube using a 10% palladium on carbon (small cartridge) using the following parameters (Temperature—60° C., Flow rate—1.0 mL/min., pressure—Full H2 (1 bar)). The solution was collected and concentrated under reduced pressure yielding the title compound as a gum (91.6 mg, 87%). Method C: 3 minute run LRMS [½M=1009]. $^1$H NMR (METHANOL-$d_4$) δ: 7.98 (s, 3H), 5.44 (d, J=4.3 Hz, 3H), 5.32 (s, 3H), 5.10 (dd, J=10.5, 4.3 Hz, 3H), 4.50-4.64 (m, 12H), 4.18 (d, J=10.5 Hz, 3H), 3.99 (d, J=8.2 Hz, 3H), 3.90 (t, J=4.9 Hz, 6H), 3.71-3.82 (m, 9H), 3.44-3.66 (m, 44H), 3.08-3.19 (m, 2H), 2.16-2.22 (m, 4H), 2.15 (s, 9H), 1.94 (d, J=1.2 Hz, 18H), 1.44-1.68 (m, 8H), 1.27-1.42 (m, 4H)

(1S,2R,3R,4R,5S)-4-(acetylamino)-1-{13-[4-({3-[(1-{1-[(1S,2R,3R,4R,5S)-4-(acetylamino)-2,3-bis(acetyloxy)-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-bis(acetyloxy)-6,8-dioxabicyclo[3.2.1]oct-1-yl]-2,5,8,11-tetraoxatridecan-13-yl}-1H-1,2,3-triazol-4-yl)methoxy]methyl}-2-({6[(6hydroxyhexanoyl)amino]hexanoyl}amino)propoxy}methyl)-1H-1,2,3-triazol-1-yl]-2,5,8,11-tetraoxatridec-1-yl}-3-(acetyloxy)-6,8-dioxabicyclo[3.2.1]oct-2-yl acetate (60)

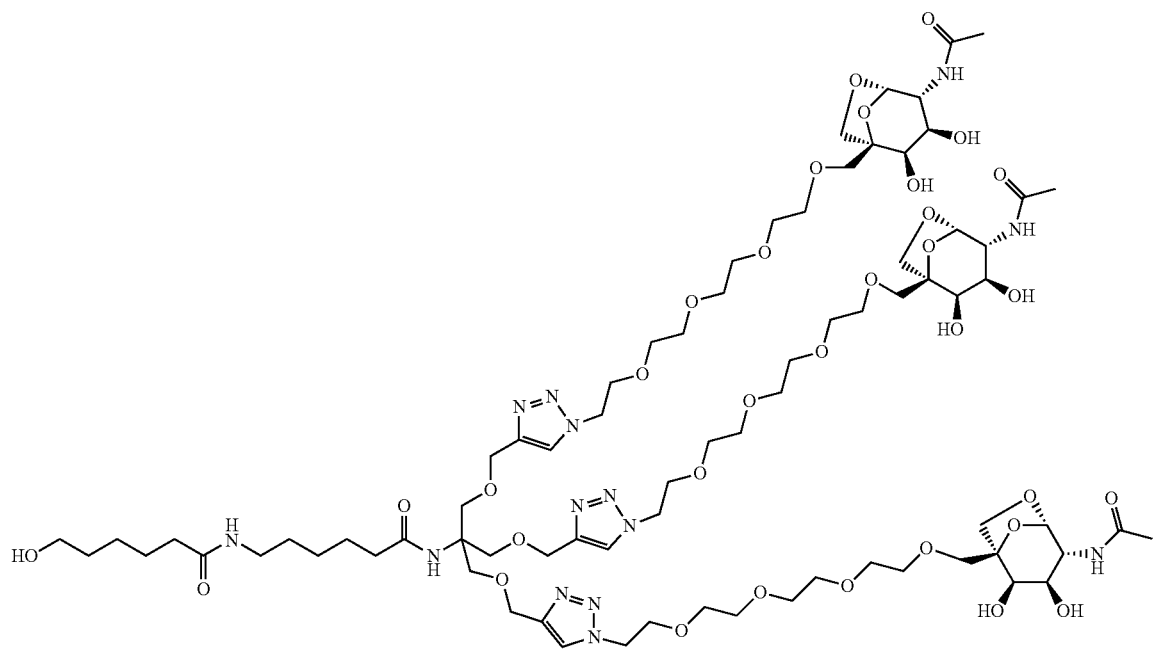 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)CCCCCO)nn3)(O2)[C@H](O)[C@@H]1O]

6-(benzyloxy)-N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}hexanamide (I-an-1) (31.0 mg, 0.017 mmol) was dissolved in methanol (5 mL) and the solution was then passed through the H-cube using a 10% palladium on carbon (small cartridge) using the following parameters (Temperature—60° C., Flow rate—1.0 mL/min., pressure—Full $H_2$ (1 bar)). The solution was collected and concentrated under reduced pressure yielding the title compound as a gum (7.9 mg, 27%). Method C: 3 minute run LRMS [M+1=1766]. $^1$H NMR (METHANOL-$d_4$) δ: 7.99 (s, 3H), 5.21 (s, 3H), 4.49-4.63 (m, 12H), 3.92-4.00 (m, 6H), 3.89 (dd, J=10.3, 4.5 Hz, 9H), 3.74-3.79 (m, 9H), 3.71 (dd, J=9.8, 4.3 Hz, 3H), 3.53-3.67 (m, 44H), 3.02-3.16 (m, 2H), 2.18 (td, J=7.3, 3.3 Hz, 4H), 1.99 (s, 9H), 1.44-1.72 (m, 8H), 1.25-1.42 (m, 4H)

benzyl [6-({6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}amino)-6-oxohexyl]carbamate (I-ag-7)

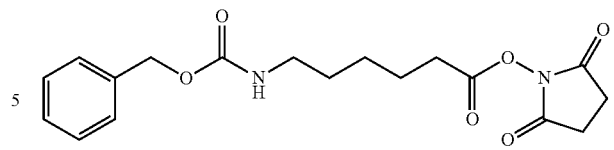

(see Journal of Heterocyclic Chemistry, 23(3), 901-3; 1986, 68.1 mg, 0.188 mmol). The reaction was allowed to stir at

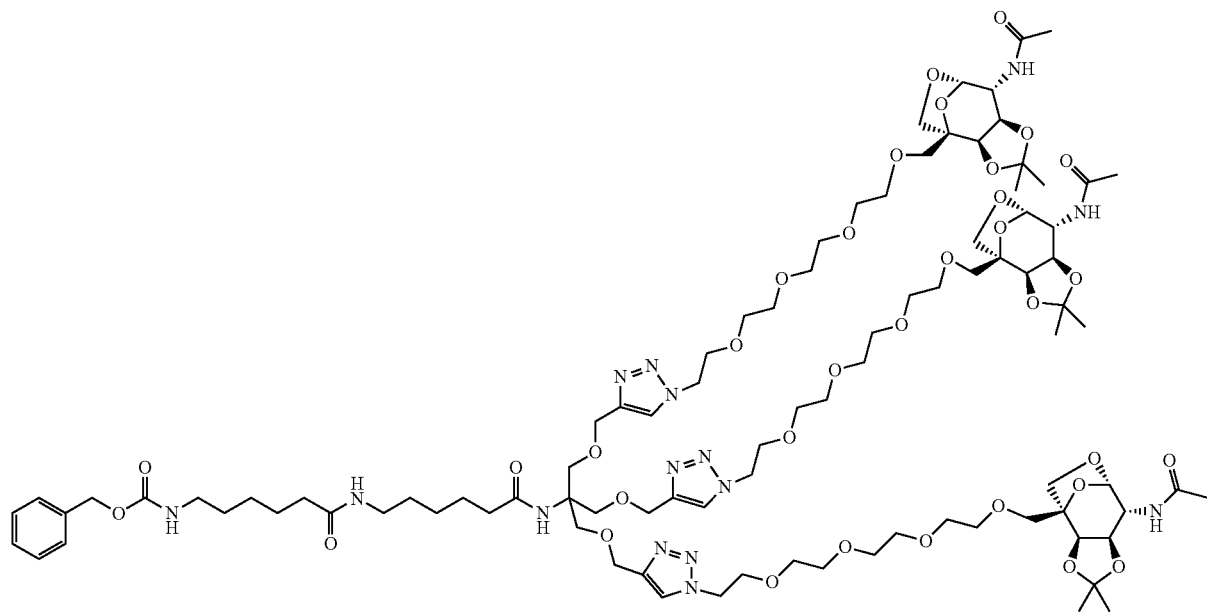 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@H]5OC(C)(C)O[C@H]56)nn4)(COCc4cn(CCOCCOCCOCCOC[C@@]56CO[C@@H](O5)[C@H](NC(C)=O)[C@H]5OC(C)(C)O[C@H]56)nn4)NC(=O)CCCCCNC(=O)CCCCCNC(=O)OCc4ccccc4)nn3)(O2)[C@@H]2OC(C)(C)O[C@H]12]

To a solution of 6-amino-N-(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)hexanamide (I-ag-1) (222 mg, 0.125 mmol) in N,N-dimethylformamide (1.5 mL) and tetrahydrofuran (1.0 mL) was added N,N-diisopropylethylamine (0.0873 mL, 0.501 mmol) and benzyl {6-[(2,5-dioxopyrrolidin-1-yl)oxy]-6-oxohexyl}carbamate room temperature for 24 hours. After 24 hours, the reaction was concentrated under reduced pressure. The crude reaction mixture was purified using the CombiFlash Rf (RediSep 12 g gold silica gel column) and eluting with a gradient of 0-20% methanol/dichloromethane yielding the title compound as a gum (250 mg, 99%). Method C: 3 minute run LRMS [½M+1=1010]. $^1$H NMR (METHANOL-$d_4$) δ: 7.98 (s, 3H), 7.22-7.40 (m, 5H), 5.22 (d, J=1.2 Hz, 3H), 5.06 (s, 2H), 4.51-4.61 (m, 12H), 4.29 (d, J=5.9 Hz, 3H), 4.16 (t, J=6.4 Hz, 3H), 3.86-3.96 (m, 12H), 3.83 (d, J=7.8 Hz, 3H), 3.73-3.79 (m, 12H), 3.53-3.70 (m, 36H), 3.04-3.19 (m, 4H), 2.17 (t, J=7.4 Hz, 4H), 1.98 (s, 9H), 1.58 (td, J=14.5, 7.6 Hz, 4H), 1.48 (s, 13H), 1.33 (s, 13H)

benzyl [6-({6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}amino)-6-oxohexyl]carbamate (61)

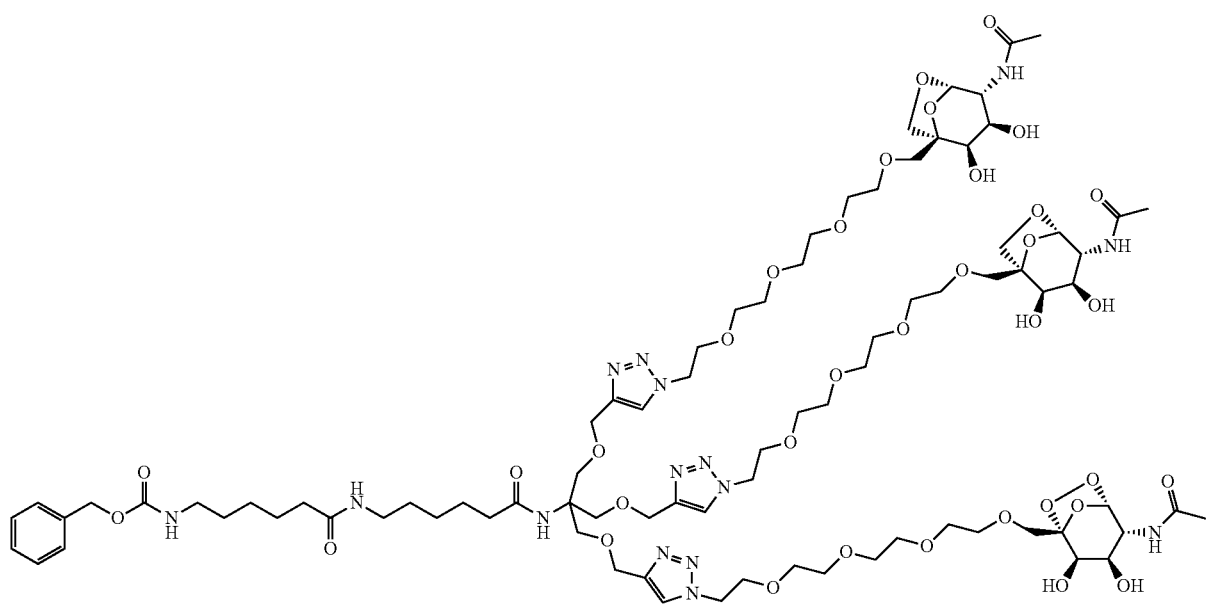 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56OO[C@@H](O5)[C@H](NC(C)=O)[C@@H](O)[C@H]6O)nn4)NC(=O)CCCCCNC(=O)CCCCCNC(=O)OCc4ccccc4)nn3)(O2)[C@H](O)[C@@H]1O]

A solution of benzyl [6-({6-[(1,3-bis[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]-2-{[(1-{1-[(1S,2R,6R,7R,8S)-7-(acetylamino)-4,4-dimethyl-3,5,9,11-tetraoxatricyclo[6.2.1.0~2,6~]undec-1-yl]-2,5,8,11-tetraoxatridecan-13-yl}-1H-1,2,3-triazol-4-yl)methoxy]methyl}propan-2-yl)amino]-6-oxohexyl}amino)-6-oxohexyl]carbamate (I-ag-7) (250.0 mg, 0.124 mmol) in acetic acid (8 mL), methanol (2 mL) and water (2 mL) was heated to 70° C. for 36 hours. After 36 hours, the reaction was cooled to room temperature and concentrated under reduced pressure. The crude material was diluted with toluene and concentrated under reduced pressure. The crude material was diluted with toluene a second time and concentrated under reduced pressure yielding the title compound as a gum (225 mg, 96%). Method C: 3 minute run LRMS [½M+1=950]. $^1$H NMR (METHANOL-d$_4$) δ: 7.98 (s, 3H), 7.22-7.41 (m, 5H), 5.21 (s, 3H), 5.05 (s, 2H), 4.57 (t, J=5.0 Hz, 6H), 4.55 (s, 6H), 3.92-4.00 (m, 6H), 3.83-3.91 (m, 9H), 3.73-3.78 (m, 9H), 3.68-3.72 (m, J=10.0, 4.1 Hz, 3H), 3.52-3.68 (m, 42H), 3.05-3.17 (m, 4H), 2.16 (t, J=7.3 Hz, 4H), 1.98 (s, 9H), 1.57-1.65 (m, 2H), 1.53-1.57 (m, 2H), 1.43-1.52 (m, 4H), 1.24-1.39 (m, 4H)

6-amino-N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1 S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}hexanamide acetate (62)

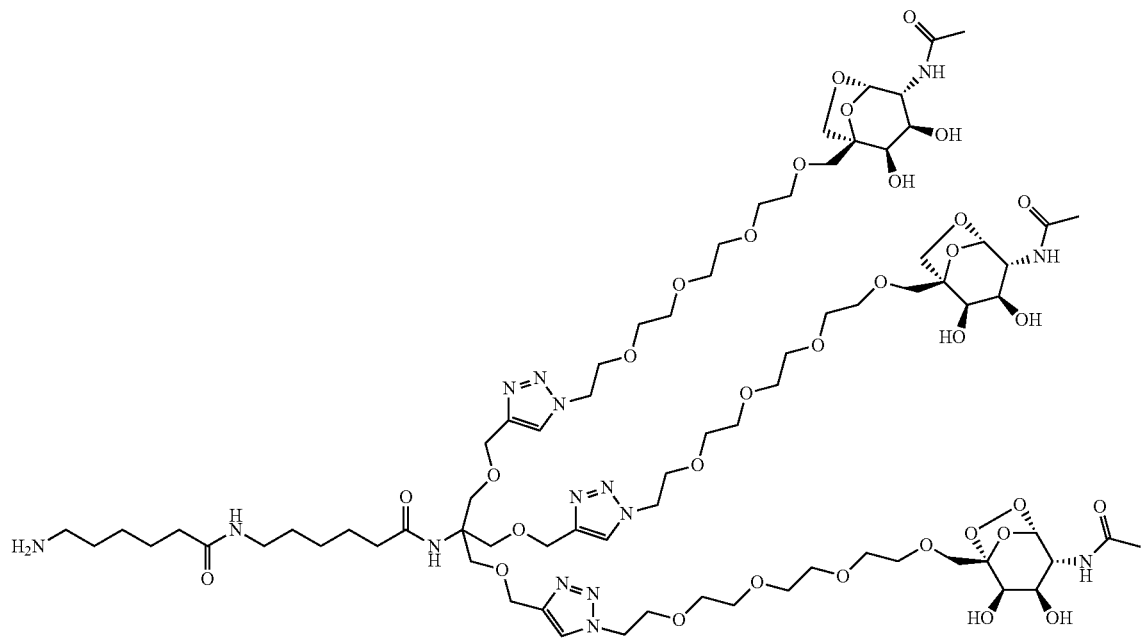 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56OO[C@@H](O5)[C@H](NC(C)=O)[C@@H](O)[C@H]6O)nn4)NC(=O)CCCCCNC(=O)CCCCCN)nn3)(O2)[C@H](O)[C@@H]1O]

benzyl [6-({6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}amino)-6-oxohexyl]carbamate (61) (200 mg, 0.105 mmol) was dissolved in methanol (20 mL) and acetic acid (0.024 mL, 0.421 mmol) and the solution was then passed through the H-cube using a 10% palladium on carbon (small cartridge) using the following parameters (Temperature—50° C., Flow rate—1.0 mL/min., pressure—Full H2 (1 bar)). The solution was collected and concentrated under reduced pressure yielding the title compound as a gum (148 mg, 77%). Method C: 3 minute run LRMS [M+45 (formic acid)=1809]. $^1$H NMR (METHANOL-d$_4$) δ: 8.02 (s, 3H), 5.23 (s, 3H), 4.59-4.63 (m, 6H), 4.58 (s, 6H), 3.97 (dd, J=9.6, 5.3 Hz, 6H), 3.91 (dd, J=11.3, 4.7 Hz, 9H), 3.76-3.82 (m, 9H), 3.73 (dd, J=10.1, 4.3 Hz, 3H), 3.56-3.70 (m, 42H), 3.16 (t, J=6.8 Hz, 2H), 2.93 (t, J=7.6 Hz, 2H), 2.16-2.29 (m, 4H), 2.01 (s, 9H), 1.92 (s, 3H), 1.62-1.74 (m, 4H), 1.54-1.61 (m, 2H), 1.46-1.53 (m, 2H), 1.39-1.45 (m, 2H), 1.29-1.38 (m, 2H)

[(1S,2R,6R,7R,8S)-7-azido-4,4-dimethyl-3,5,9,11-tetraoxatricyclo[6.2.1.0~2,6~]undec-1-yl]methanol (I-d-1)

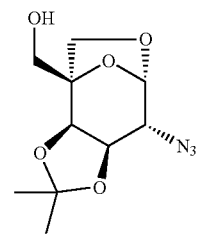 [SMILES: CC1(C)O[C@@H]2[C@@H](N=[N+]=[N-])[C@H]3OC[C@](CO)(O3)[C@@H]2O1]

To a solution of (1S,2R,3R,4R,5S)-4-azido-1-(hydroxymethyl)-6,8-dioxabicyclo[3.2.1]octane-2,3-diol (1) (2.52 g, 11.61 mmol) in N,N-dimethylformamide (21 mL) was added 2 2-dimethoxypropane (9.0 mL, 69.6 mmol) followed by (1S)-(+)-10-Camphorsulfonic acid (1.08 g, 4.65 mmol). The reaction was heated to 70° C. over 24 hours. After 24 hours, the reaction was cooled to room temperature before the addition of methanol (5 mL) was added followed by the addition of triethylamine (0.22 mL, 1.55 mmol) and the solution was stirred for 10 minutes before being concentrated under reduced pressure. The crude material was purified using the CombiFlash Rf (RediSep 80 g Gold silica gel column) and eluting with a gradient of 0-20% methanol/dichloromethane yielding impure title compound. The crude material was purified using the CombiFlash Rf (RediSep 40 g Gold silica gel column) and eluting with a gradient of 0-100% ethyl acetate/heptane yielding the title compound (2419 mg, 81%). $^1$H NMR (METHANOL-$d_4$) δ: 5.42 (d, J=1.6 Hz, 1H), 4.34-4.43 (m, 2H), 3.88-3.98 (m, 3H), 3.81-3.87 (m, 1H), 3.37 (dd, J=6.2, 1.6 Hz, 1H), 1.54 (s, 3H), 1.42 (s, 3H)

(1S,2R,6R,7R,8S)-7-azido-4,4-dimethyl-1-(15-phenyl-2,5,8,11,14-pentaoxapentadec-1-yl)-3,5,9,11-tetraoxatricyclo[6.2.1.0~2,6~]undecane (I-d-2)

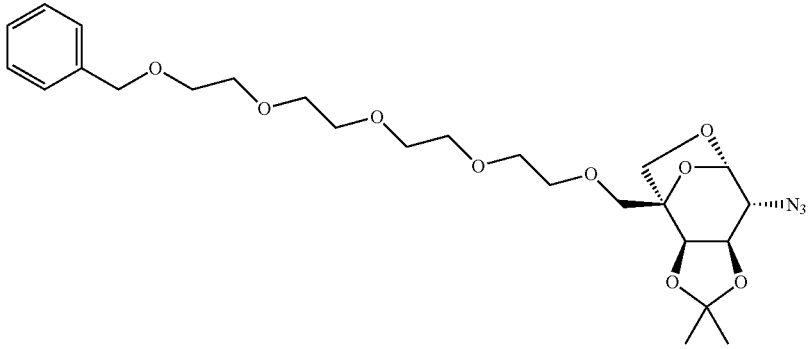 [SMILES: CC1(C)O[C@@H]2[C@@H](N=[N+]=[N-])[C@H]3OC[C@](COCCOCCOCCOCCOCc4ccccc4)(O3)[C@@H]2O1]

To a solution of [(1S,2R,6R,7R,8S)-7-azido-4,4-dimethyl-3,5,9,11-tetraoxatricyclo[6.2.1.0~2,6~]undec-1-yl]methanol (I-d-1) (490 mg, 1.90 mmol) in tetrahydrofuran (5 mL) was added sodium hydride 60% dispersion in mineral oil (127 mg, 3.2 mmol) at room temperature. The reaction was allowed to stir under nitrogen for 30 minutes before the addition of 13-iodo-1-phenyl-2,5,8,11-tetraoxatridecane (1130 mg, 2.86 mmol) in tetrahydrofuran (2 mL). The reaction was allowed to stir overnight at room temperature. The following morning (18 hours), the reaction was quenched with water and extracted with ethyl acetate. The aqueous layer was washed with ethyl acetate two additional times. The combined organic layers were washed with water, brine, dried over sodium sulfate, filtered and concentrated under reduced pressure. The crude material was purified using the CombiFlash Rf (ISCO RediSep Gold 40 g silica gel column) and eluting with a gradient of 0-100% ethyl acetate/heptane yielding the title compound as a gum (336.0 mg, 34%). Method C: 1.5 minute run LRMS [M+Na=546]. $^1$H NMR (METHANOL-$d_4$) δ: 7.17-7.47 (m, 5H), 5.35 (d, J=1.6 Hz, 1H), 4.55 (s, 2H), 4.32-4.37 (m, 1H), 4.25-4.32 (m, 1H), 3.92 (d, J=10.1 Hz, 1H), 3.88 (d, J=8.2 Hz, 1H), 3.73-3.80 (m, 2H), 3.55-3.71 (m, 17H), 1.49 (s, 3H), 1.36 (s, 3H)

tert-butyl [(1S,2R,6R,7R,8S)-1-(13-hydroxy-2,5,8,11-tetraoxatridec-1-yl)-4,4-dimethyl-3,5,9,11-tetraoxatricyclo[6.2.1.0~2,6~]undec-7-yl]carbamate (I-ao-1)

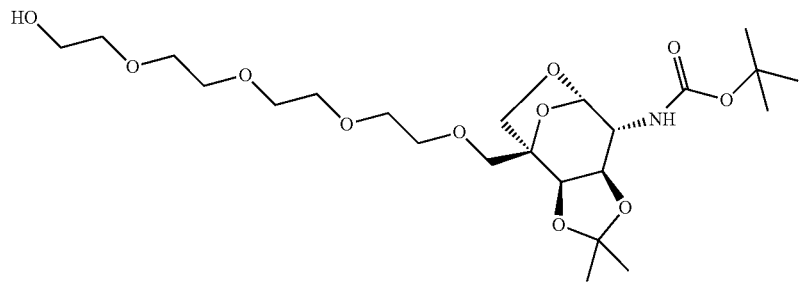 [SMILES: CC(C)(C)OC(=O)N[C@H]1[C@H]2OC[C@](COCCOCCOCCOCCO)(O2)[C@@H]2OC(C)(C)O[C@H]12]

The starting material (1S,2R,6R,7R,8S)-7-azido-4,4-dimethyl-1-(15-phenyl-2,5,8,11,14-pentaoxapentadec-1-yl)-3,5,9,11-tetraoxatricyclo[6.2.1.0~2,6~]undecane (I-d-2) (310.0 mg, 0.592 mmol) was dissolved in methanol (6 mL) followed by the addition of di-tert-butyl-dicarbonate (162 mg, 0.74 mmol) and 10% palladium on carbon (50% wet wt/wt., 100.0 mg, 0.940 mmol) in a 50 mL reactor. The reactor was sealed and the reaction was purged three times with nitrogen (50 psi) and then purged two times with hydrogen (50 psi) and filled to 50 psi with hydrogen and stirred overnight. The following morning (24 hours), the reaction was filtered through a celite plug and washed with methanol. The filtrate was concentrated under reduced pressure. The crude material was purified using the CombiFlash Rf (RediSep 12 g silica gel column) and eluting with a gradient of 0-20% methanol/dichloromethane yielding the title compound as an gum (304 mg, 100%). Method C: 3 minute run LRMS [M+Na=530]. $^1$H NMR (METHANOL-$d_4$) δ: 5.22 (s, 1H), 4.28 (d, J=5.9 Hz, 1H), 4.11 (t, J=6.4 Hz, 1H), 3.93 (d, J=10.1 Hz, 1H), 3.80-3.85 (m, 1H), 3.76 (d, J=6.2 Hz, 1H), 3.74 (d, J=3.9 Hz, 1H), 3.60-3.71 (m, 15H), 3.53-3.59 (m, 2H), 1.50 (s, 3H), 1.45 (s, 9H), 1.34 (s, 3H)

1-{(1S,2R,6R,7R,8S)-7-[(tert-butoxycarbonyl)amino]-4,4-dimethyl-3,5,9,11-tetraoxatricyclo[6.2.1.0~2,6~]undec-1-yl}-2,5,8,11-tetraoxatridecan-13-yl methanesulfonate (I-ap-1)

5.22 (s, 1H), 4.33-4.43 (m, 2H), 4.28 (d, J=5.9 Hz, 1H), 4.11 (t, J=6.4 Hz, 1H), 3.93 (d, J=10.1 Hz, 1H), 3.80-3.86 (m, 1H), 3.72-3.79 (m, 4H), 3.61-3.70 (m, 12H), 3.58 (d, J=5.9 Hz, 1H), 3.11 (s, 3H), 1.50 (s, 3H), 1.45 (s, 9H), 1.34 (s, 3H)

tert-butyl [(1S,2R,6R,7R,8S)-1-(13-azido-2,5,8,11-tetraoxatridec-1-yl)-4,4-dimethyl-3,5,9,11-tetraoxatricyclo[6.2.1.0~2,6~]undec-7-yl]carbamate (I-aq-1)

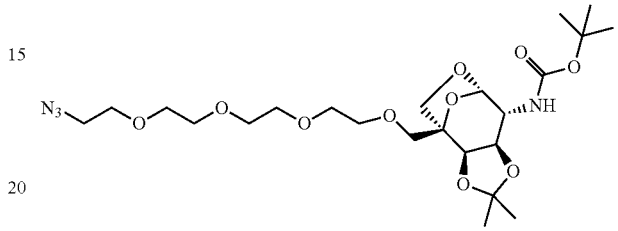

To a solution of 1-{(1S,2R,6R,7R,8S)-7-[(tert-butoxycarbonyl)amino]-4,4-dimethyl-3,5,9,11-tetraoxatricyclo[6.2.1.0~2,6~]undec-1-yl}-2,5,8,11-tetraoxatridecan-13-yl methanesulfonate (I-ap-1) (339 mg, 0.579 mmol) in N,N-dimethylformamide (1.5 mL) was added sodium azide (67.7

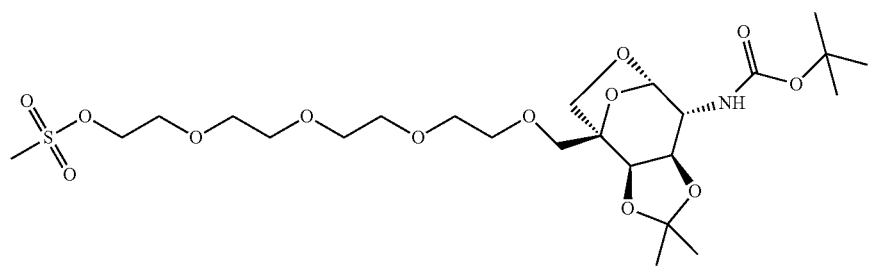 [SMILES: CC(C)(C)OC(=O)N[C@H]1[C@H]2OC[C@](COCCOCCOCCOCCOS(C)(=O)=O)(O2)[C@@H]2OC(C)(C)O[C@H]12]

To a solution of tert-butyl [(1S,2R,6R,7R,8S)-1-(13-hydroxy-2,5,8,11-tetraoxatridec-1-yl)-4,4-dimethyl-3,5,9,11-tetraoxatricyclo[6.2.1.0~2,6~]undec-7-yl]carbamate (I-ao-1) (300.0 mg, 0.591 mmol) in dichloromethane (2 mL) was added triethyl amine (0.332 mL, 2.36 mmol) and cooled to 0° C. using an ice bath followed by the addition of methanesulphonyl chloride (0.055 mL, 0.71 mmol). The reaction was allowed to warm slowly to room temperature and stirred at room temperature for 20 hours. After 20 hours, the reaction was quenched with water and extracted. The layers were separated and the aqueous layer was extracted an additional time with dichloromethane. The combined organic layers were washed with brine, dried over magnesium sulfate, filtered and concentrated under reduced pressure yielding the title compound as an oil (339 mg, 98%). Method C: 3 minute run LRMS [M+Na=608]. $^1$H NMR (METHANOL-$d_4$) δ:

mg, 1.04 mmol) and the reaction was heated to 100° C. overnight in a sealed 5 mL microwave vial. After 18 hours, the reaction was cooled to room temperature and the reaction was diluted with water and extracted with ethyl acetate three times. The combined organic layers were washed with water, brine, dried over sodium sulfate, filtered and concentrated under reduced pressure yielding The crude material was purified using the CombiFlash Rf (RediSep 12 g Gold silica gel column) and eluting with a gradient of 0-20% methanol/dichloromethane yielding the title compound as a gum (246 mg, 80%). $^1$H NMR (METHANOL-$d_4$) δ: 5.24 (s, 1H), 4.30 (d, J=5.9 Hz, 1H), 4.13 (t, J=6.4 Hz, 1H), 3.95 (d, J=9.8 Hz, 1H), 3.82-3.88 (m, 1H), 3.75-3.80 (m, 2H), 3.53-3.74 (m, 15H), 3.39 (t, J=4.9 Hz, 2H), 1.52 (s, 3H), 1.47 (s, 9H), 1.36 (s, 3H)

tert-butyl {(1S,2R,6R,7R,8S)-1-[13-(4-{[2-{[4-(benzyloxy)butanoyl]amino}-3-{[1-(1-{(1S,2R,6R,7R,8S)-7-[(tert-butoxycarbonyl)amino]-4,4-dimethyl-3,5,9,11-tetraoxatricyclo[6.2.1.0~2,6~]undec-1-yl}-2,5,8,11-tetraoxatridecan-13-yl)-1H-1,2,3-triazol-4-yl]methoxy}-2-({[1-(1-{(1S,2R,6R,7R,8S)-7-[(tert-butoxycarbonyl)amino]-4,4-dimethyl-3,5,9,11-tetraoxatricyclo[6.2.1.0~2,6~]undec-1-yl}-2,5,8,11-tetraoxatridecan-13-yl)-1H-1,2,3-triazol-4-yl]methoxy}methyl)propoxy]methyl}-1H-1,2,3-triazol-1-yl)-2,5,8,11-tetraoxatridec-1-yl]-4,4-dimethyl-3,5,9,11-tetraoxatricyclo[6.2.1.0~2,6~]undec-7-yl}carbamate (I-ar-1)

A 20 mL vial equipped with stir bar was charged with 4-(benzyloxy)-N-{1,3-bis(prop-2-yn-1-yloxy)-2-[(prop-2-yn-1-yloxy)methyl]propan-2-yl}butanamide (I-v-1) (45.0 mg, 0.11 mmol) and to which was added tert-butyl [(1 S,2R,6R,7R,8S)-1-(13-azido-2,5,8,11-tetraoxatridec-1-yl)-4,4-dimethyl-3,5,9,11-tetraoxatricyclo[6.2.1.0~2,6~]undec-7-yl]carbamate (I-aq-1) (192 mg, 0.361 mmol) in t-butanol (3 mL) and water (1.5 mL, deionized water). The reaction was purged with nitrogen for 5 minutes before the addition of sodium ascorbate (66.3 mg, 0.328 mmol) and the drop wise addition of a solution of copper (II) sulfate (5.24 mg, 0.0328 mmol) in water (500 uL, deionized water). The reaction was stirred at room temperature for 20 hours. After 20 hours, the reaction was cooled to room temperature and the reaction was quenched by adding the reaction mixture to a saturated ammonium chloride (30 mL) and conc. ammonium hydroxide (2 mL) and extracted three times with dichloromethane (15 mL). The combined organic layers were dried over sodium sulfate, filtered and concentrated under reduced pressure. The crude material was purified using the CombiFlash Rf (RediSep 12 g Gold silica gel column) and eluting with a gradient of 0-20% methanol/dichloromethane yielding the title compound as a gum (165 mg, None, 75%). Method C: 3 minute run LRMS [½M+1=1005]. $^1$H NMR (METHANOL-$d_4$) δ: 7.97 (s, 3H), 7.17-7.43 (m, 5H), 5.21 (s, 3H), 4.52-4.60 (m, 12H), 4.45 (s, 2H), 4.25 (d, J=5.9 Hz, 3H), 4.10 (t, J=6.2 Hz, 3H), 3.85-3.93 (m, 9H), 3.71-3.82 (m, 15H), 3.63-3.69 (m, 6H), 3.53-3.62 (m, 33H), 3.48 (t, J=6.2 Hz, 2H), 2.27 (t, J=7.2 Hz, 2H), 1.74-1.96 (m, 2H), 1.49 (s, 9H), 1.45 (s, 27H), 1.32 (s, 9H)

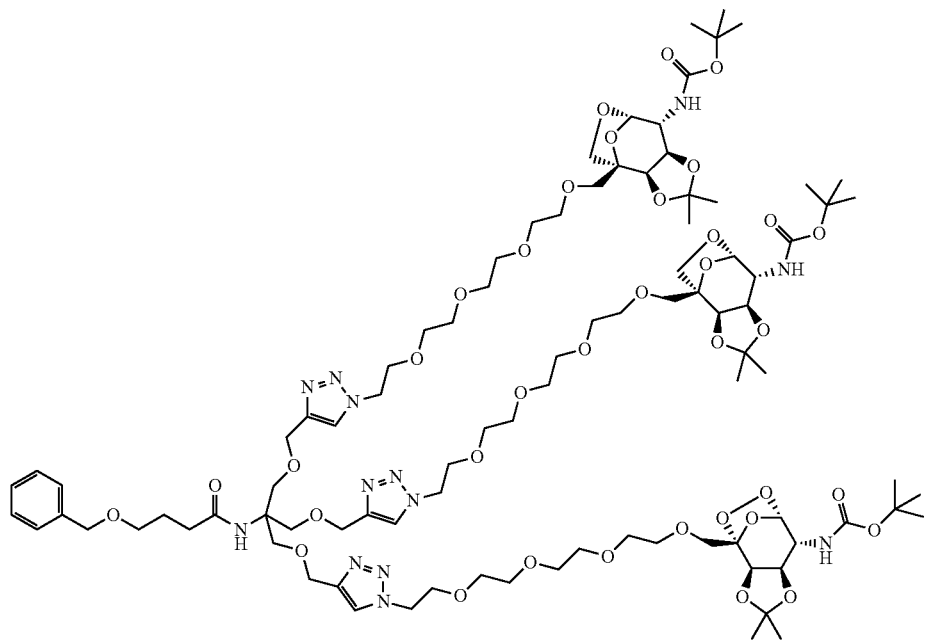 [SMILES: CC(C)(C)OC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(=O)OC(C)(C)C)[C@H]5OC(C)(C)O[C@H]56)nn4)(COCc4cn(CCOCCOCCOCCOC[C@@]56OO[C@@H](O5)[C@H](NC(=O)OC(C)(C)C)[C@H]5OC(C)(C)O[C@H]56)nn4)NC(=O)CCCOCc4ccccc4)nn3)(O2)[C@@H]2OC(C)(C)O[C@H]12]

4-(benzyloxy)-N-(1,3-bis[(1-{1-[(1S,2R,3R,4R,5S)-4-amino-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-amino-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)butanamide (63)

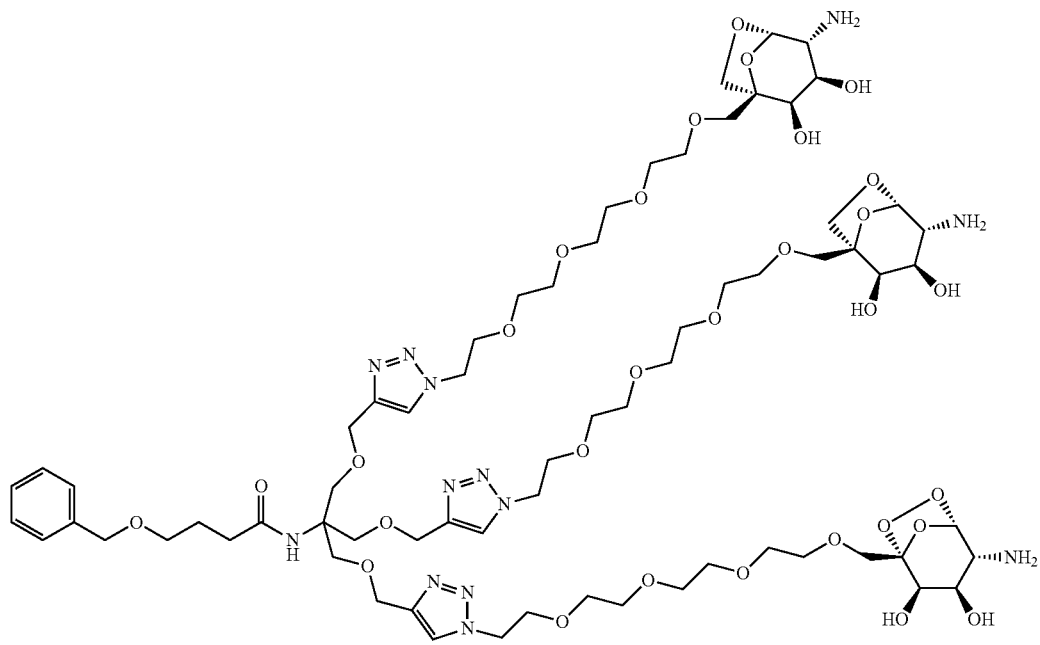 [SMILES: N[C@H]1[C@H]2OC[C@](COCCOCCOCCOCCn3cc(COCC(COCc4cn(CCOCCOCCOCCOC[C@@]56CO[C@@H](O5)[C@H](N)[C@@H](O)[C@H]6O)nn4)(COCc4cn(CCOCCOCCOCCOC[C@@]56OO[C@@H](O5)[C@H](N)[C@@H](O)[C@H]6O)nn4)NC(=O)CCCOCc4ccccc4)nn3)(O2)[C@H](O)[C@@H]1O]

A solution of tert-butyl {(1S,2R,6R,7R,8S)-1-[13-(4-{[2-{[4-(benzyloxy)butanoyl]amino}-3-{[1-(1-{(1S,2R,6R,7R,8S)-7-[(tert-butoxycarbonyl)amino]-4,4-dimethyl-3,5,9,11-tetraoxatricyclo[6.2.1.0~2,6~]undec-1-yl}-2,5,8,11-tetraoxatridecan-13-yl)-1H-1,2,3-triazol-4-yl]methoxy}-2-({[1-(1-{(1S,2R,6R,7R,8S)-7-[(tert-butoxycarbonyl)amino]-4,4-dimethyl-3,5,9,11-tetraoxatricyclo[6.2.1.0~2,6~]undec-1-yl}-2,5,8,11-tetraoxatridecan-13-yl)-1H-1,2,3-triazol-4-yl]methoxy}methyl)propoxy]methyl}-1H-1,2,3-triazol-1-yl)-2,5,8,11-tetraoxatridec-1-yl]-4,4-dimethyl-3,5,9,11-tetraoxatricyclo[6.2.1.0~2,6~]undec-7-yl}carbamate (I-ar-1) (150.0 mg, 0.0747 mmol) in acetic acid (5 mL), methanol (1.5 mL) and water (1.5 mL) was heated to 70° C. for 18 hours. After 18 hours, the reaction was cooled to room temperature and concentrated under reduced pressure. The crude material was diluted with dichloromethane (10 mL) and methanol (4 mL) to which was added 4.0M hydrogen chloride in dioxane (2.0 mL, 8 mmol). The reaction mixture was stirred at room temperature overnight. After 18 hours, the reaction was concentrated under reduced pressure. The crude material was diluted with ethyl acetate (1 mL) and to which was added heptane (10 mL) and concentrated under reduced pressure. The material was then placed under high vacuum for 18 hours yielding the title compound (139.0 mg, 103%). Method C: 3 minute run LRMS [½M+1=795]. $^1$H NMR (METHANOL-$d_4$) δ: 8.09 (s, 3H), 7.27-7.39 (m, 5H), 5.48 (s, 3H), 4.57-4.66 (m, 12H), 4.47 (s, 2H), 3.98 (d, J=9.8 Hz, 3H), 3.90-3.95 (m, 9H), 3.82-3.89 (m, 6H), 3.79 (s, 6H), 3.76 (d, J=8.2 Hz, 3H), 3.71 (d, J=9.8 Hz, 3H), 3.57-3.69 (m, 36H), 3.50 (t, J=6.2 Hz, 2H), 3.21 (d, J=9.4 Hz, 3H), 2.29 (t, J=7.2 Hz, 2H), 1.85 (quin, J=6.8 Hz, 2H)

(1S,2R,3R,4R,5S)-4-(acetylamino)-1-(13-{4-[(3-[(1-{1-[(1S,2R,3R,4R,5S)-4-(acetylamino)-2,3-bis(acetyloxy)-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-bis(acetyloxy)-6,8-dioxabicyclo[3.2.1]oct-1-yl]-2,5,8,11-tetraoxatridecan-13-yl}-1H-1,2,3-triazol-4-yl)methoxy]methyl}-2-{[4-(benzyloxy)butanoyl]amino}propoxy)methyl]-1H-1,2,3-triazol-1-yl}-2,5,8,11-tetraoxatridec-1-yl)-3-(acetyloxy)-6,8-dioxabicyclo[3.2.1]oct-2-yl acetate (I-as-1)

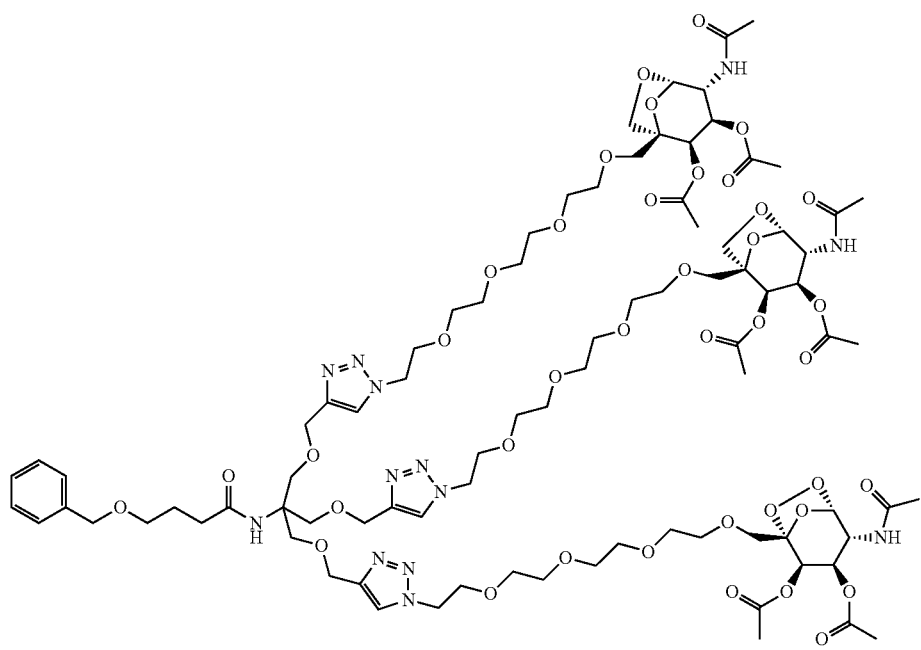 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](OC(C)=O)[C@H]6OC(C)=O)nn4)(COCc4cn(CCOCCOCCOCCOC[C@@]56OO[C@@H](O5)[C@H](NC(C)=O)[C@@H](OC(C)=O)[C@H]6OC(C)=O)nn4)NC(=O)CCCOCc4ccccc4)nn3)(O2)[C@H](OC(C)=O)[C@@H]1OC(C)=O]

4-(benzyloxy)-N-(1,3-bis[(1-{1-[(1S,2R,3R,4R,5S)-4-amino-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-amino-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)butanamide (63) (80 mg, 0.044 mmol) was dissolved in pyridine (anhydrous) (1.5 mL, 19 mmol) and to which was added acetic anhydride (0.125 mL, 1.33 mmol) at room temperature. The reaction was then heated to 50° C. overnight. The following morning, the reaction was concentrated under reduced pressure. The crude material was purified using the CombiFlash Rf (RediSep 12 g gold silica gel column) and eluting with a gradient of 0-20% methanol/dichloromethane yielding crude title compound. The crude title compound was purified using the CombiFlash Rf (RediSep 4 g gold silica gel column) and eluting with a gradient of 0-20% methanol/dichloromethane yielding the title compound as a gum (54.0 mg, 62%). Method C: 1.5 minute run LRMS [½M+1=984]. $^1$H NMR (METHANOL-$d_4$) δ: 7.97 (s, 3H), 7.19-7.42 (m, 5H), 5.44 (d, J=4.3 Hz, 3H), 5.31 (s, 3H), 5.10 (dd, J=10.3, 4.1 Hz, 3H), 4.51-4.64 (m, 12H), 4.45 (s, 2H), 4.18 (d, J=10.1 Hz, 3H), 3.99 (d, J=8.6 Hz, 3H), 3.88 (t, J=4.9 Hz, 6H), 3.68-3.82 (m, 12H), 3.52-3.64 (m, 39H), 3.48 (t, J=6.2 Hz, 2H), 2.26 (t, J=7.4 Hz, 2H), 2.15 (s, 9H), 1.94 (d, J=1.2 Hz, 18H), 1.84 (t, J=6.8 Hz, 2H).

(1S,2R,3R,4R,5S)-4-(acetylamino)-1-{13-[4-({3-[(1-
{1-[(1S,2R,3R,4R,5S)-4-(acetylamino)-2,3-bis
(acetyloxy)-6,8-dioxabicyclo[3.2.1]oct-1-yl]-2,5,8,
11-tetraoxatridecan-13-yl}-1H-1,2,3-triazol-4-yl)
methoxy]-2-{[(1-{1-[(1S,2R,3R,4R,5S)-4-
(acetylamino)-2,3-bis(acetyloxy)-6,8-dioxabicyclo
[3.2.1]oct-1-yl]-2,5,8,11-tetraoxatridecan-13-yl}-1H-
1,2,3-triazol-4-yl)methoxy]methyl}-2-[(4-
hydroxybutanoyl)amino]propoxy}methyl)-1H-1,2,3-
triazol-1-yl]-2,5,8,11-tetraoxatridec-1-yl}-3-
(acetyloxy)-6,8-dioxabicyclo[3.2.1]oct-2-yl acetate
(I-at-1)
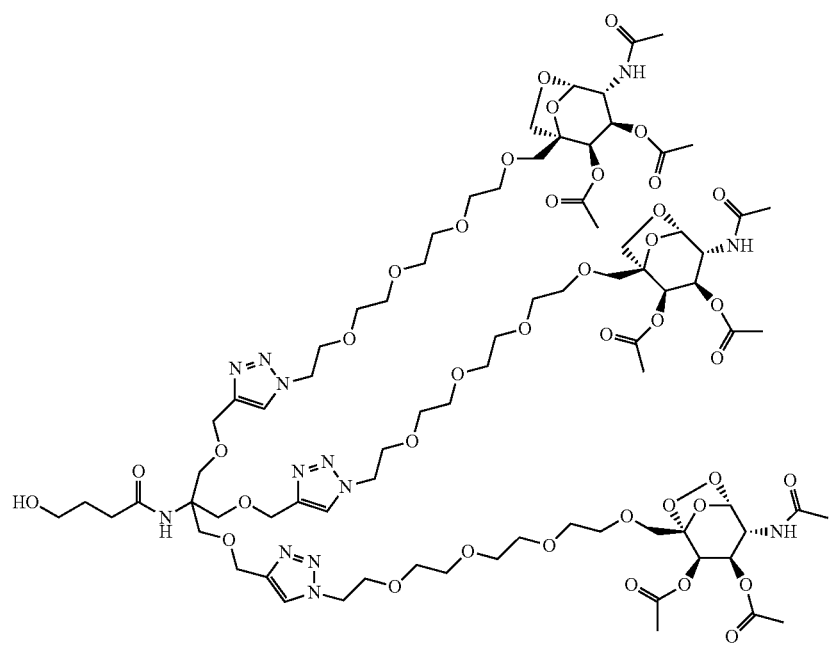 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](OC(C)=O)[C@H]6OC(C)=O)nn4)(COCc4cn(CCOCCOCCOCCOC[C@@]56OO[C@@H](O5)[C@H](NC(C)=O)[C@@H](OC(C)=O)[C@H]6OC(C)=O)nn4)NC(=O)CCCO)nn3)(O2)[C@H](OC(C)=O)[C@@H]1OC(C)=O]

(1S,2R,3R,4R,5S)-4-(acetylamino)-1-(13-{4-[(3-[(1-{1-[(1S,2R,3R,4R,5S)-4-(acetylamino)-2,3-bis (acetyloxy)-6,8-dioxabicyclo[3.2.1]oct-1-yl]-2,5,8, 11-tetraoxatridecan-13-yl}-1H-1,2,3-triazol-4-yl) methoxy]-2-{[(1-{1-[(1S,2R,3R,4R,5S)-4-(acetylamino)-2,3-bis(acetyloxy)-6,8-dioxabicyclo [3.2.1]oct-1-yl]-2,5,8,11-tetraoxatridecan-13-yl}-1H-1,2,3-triazol-4-yl)methoxy]methyl}-2-{[4-(benzyloxy)butanoyl]amino}propoxy)methyl]-1H-1, 2,3-triazol-1-yl}-2,5,8,11-tetraoxatridec-1-yl)-3-(acetyloxy)-6,8-dioxabicyclo[3.2.1]oct-2-yl acetate (I-as-1) (54.0 mg, 0.027 mmol) was dissolved in methanol (10.0 mL) and the solution was then passed through the H-cube using a 10% palladium on carbon (small cartridge) using the following parameters (Temperature—60° C., Flow rate—1.0 mL/min., pressure—Full H₂ (1 atm)). The solution was collected and concentrated under reduced pressure yielding the title compound as a gum (51.0 mg, 99%). Method C: 3 minute run LRMS [M+Na=1899]. $^1$H NMR (METHANOL-d₄) δ: 7.98 (s, 3H), 5.44 (d, J=4.3 Hz, 3H), 5.32 (s, 3H), 5.10 (dd, J=10.5, 3.9 Hz, 3H), 4.41-4.66 (m, 12H), 4.18 (d, J=10.5 Hz, 3H), 3.99 (d, J=8.6 Hz, 3H), 3.90 (t, J=5.1 Hz, 6H), 3.68-3.83 (m, 12H), 3.51-3.67 (m, 41H), 2.24 (t, J=7.6 Hz, 2H), 2.15 (s, 9H), 1.94 (s, 18H), 1.69-1.83 (m, 2H)

N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1 S,2R,3R,4R,5S)-4-(acetylamino)-2,3-dihydroxy-6,8-dioxabicyclo[3.2.1] oct-1-yl]-2,5,8,11-tetraoxatridecan-13-yl}-1H-1,2,3-triazol-4-yl)methoxy]methyl}propan-2-yl)-4-hydroxybutanamide (64)

[(1-{1-[(1S,2R,3R,4R,5S)-4-(acetylamino)-2,3-bis (acetyloxy)-6,8-dioxabicyclo[3.2.1]oct-1-yl]-2,5,8,11-tetraoxatridecan-13-yl}-1H-1,2,3-triazol-4-yl)methoxy] methyl}-2-[(4-hydroxybutanoyl)amino]propoxy}methyl)-1H-1,2,3-triazol-1-yl]-2,5,8,11-tetraoxatridec-1-yl}-3-(acetyloxy)-6,8-dioxabicyclo[3.2.1]oct-2-yl acetate (I-at-1) (8.5 mg, 0.0045 mmol) in methanol (1 mL) was added 0.5M sodium methoxide in methanol (0.154 mL mg, 0.0770 mmol) and the reaction was allowed to stir at room temperature for 3 hours. After 3 hours, the reaction was neutralized by the addition of triple methanol rinsed Amberlyst 15 ion exchange resin (CAS#=39389-20-3, RS-106008) to a pH=5. The reaction mixture was filtered and the resin was rinsed two times with methanol. The filtrate was concentrated under reduced pressure yielding the title compound as a gum (1.5 mg, 20%). Method C: 3 minute run LRMS [M+45 (formic acid)=1668]. $^1$H NMR (METHANOL-d₄) δ: 8.00 (s, 3H), 5.21 (s, 3H), 4.53-4.65 (m, 12H), 3.92-4.00 (m, 6H), 3.89 (dd, J=11.1, 4.9 Hz, 9H), 3.74-3.79 (m, 9H), 3.71 (dd, J=9.8, 4.3 Hz, 3H), 3.52-3.69 (m, 44H), 2.24 (t, J=7.4 Hz, 2H), 1.99 (s, 9H), 1.76 (quin, J=6.9 Hz, 2H)

The ortho ester linker exemplified by compound (66) in Scheme 4 and described generically in Scheme 3 could be synthesized by one skilled in the art utilizing (I-aw-1) (see H. Bruyère et al, *Bioorg. Med. Chem. Lett.*, 20, 2200-2203, (2010)) and an appropriate alcohol such as (I-an-1), the appropriate acid such as pyridinium p-toluene sulfonate in an appropriate solvent such as toluene under refluxing conditions to produce (I-ax-1). Deprotection of (I-ax-1) could be accomplished under basic conditions known to one skilled in the art (such as catalytic potassium carbonate in methanol) which would result in compound (65) of the present invention. Further functionalization of (65) could be accomplished to produce additional compounds claimed in the present invention. Thus, treatment of (65) with an appropriate acid and coupling agent (known to those skilled in the art) or an

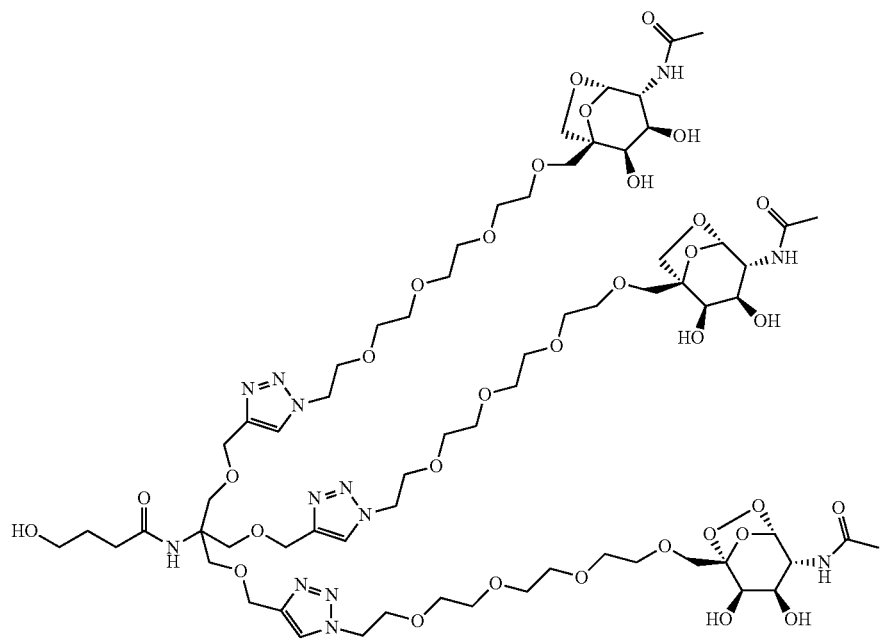 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56OO[C@@H](O5)[C@H](NC(C)=O)[C@@H](O)[C@H]6O)nn4)NC(=O)CCCO)nn3)(O2)[C@H](O)[C@@H]1O]

To a solution of (1S,2R,3R,4R,5S)-4-(acetylamino)-1-{13-[4-({3-[(1-{1-[(1S,2R,3R,4R,5S)-4-(acetylamino)-2,3-bis(acetyloxy)-6,8-dioxabicyclo[3.2.1]oct-1-yl]-2,5,8,11-tetraoxatridecan-13-yl}-1H-1,2,3-triazol-4-yl)methoxy]-2-{ activated ester (such as hydroxysuccinamide) such as (I-s-1) in an appropriate solvent such as N,N-dimethylformamide using an appropriate base such as N,N-diisopropylethylamine could produce compound (66).

Scheme 3.
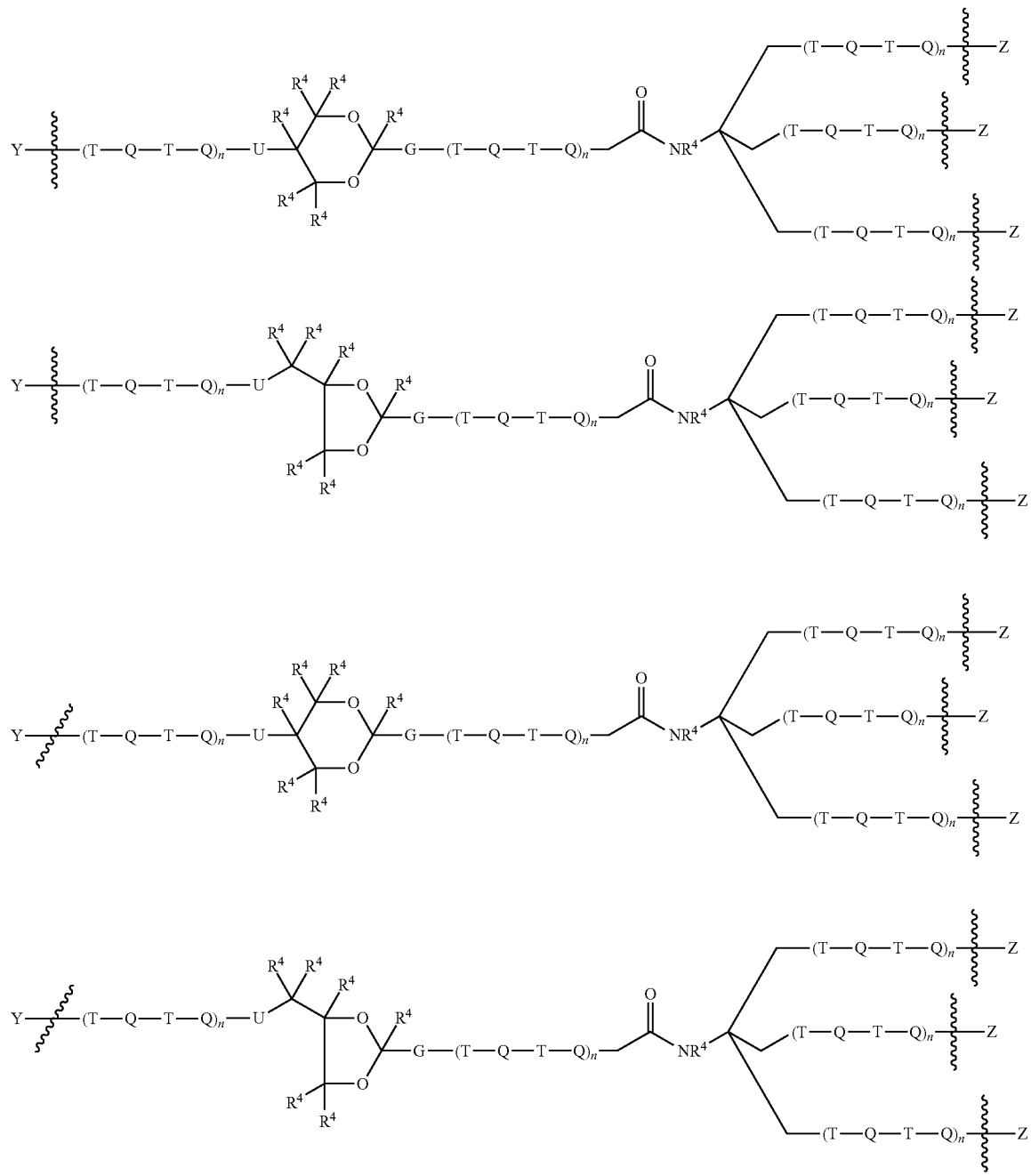
G = O, NR⁴, S
U = O, NR⁴, S, CH₂
Scheme 4.
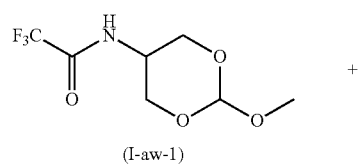
(I-aw-1)

-continued
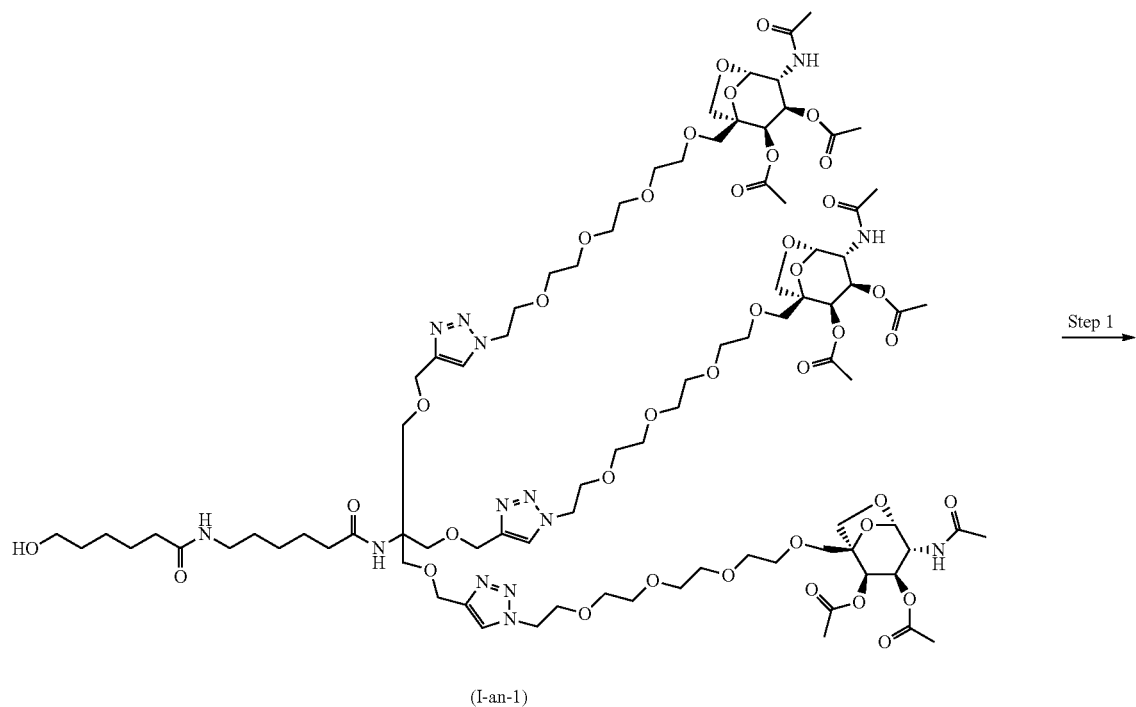
(I-an-1)
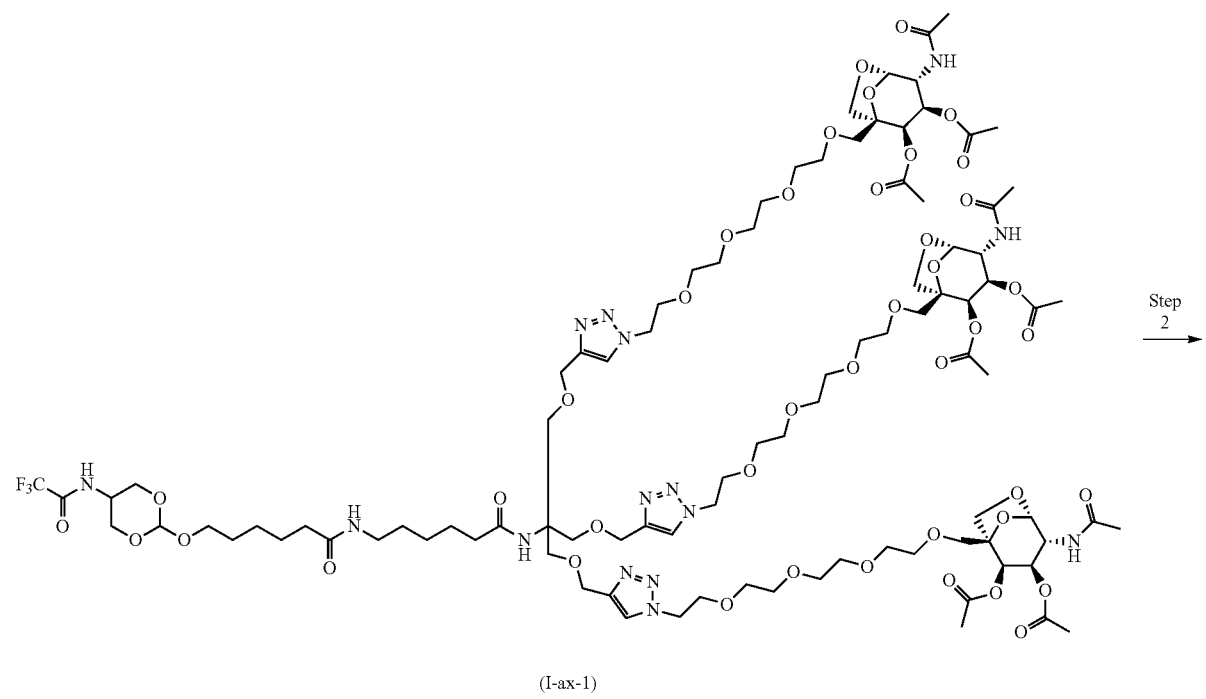
(I-ax-1)

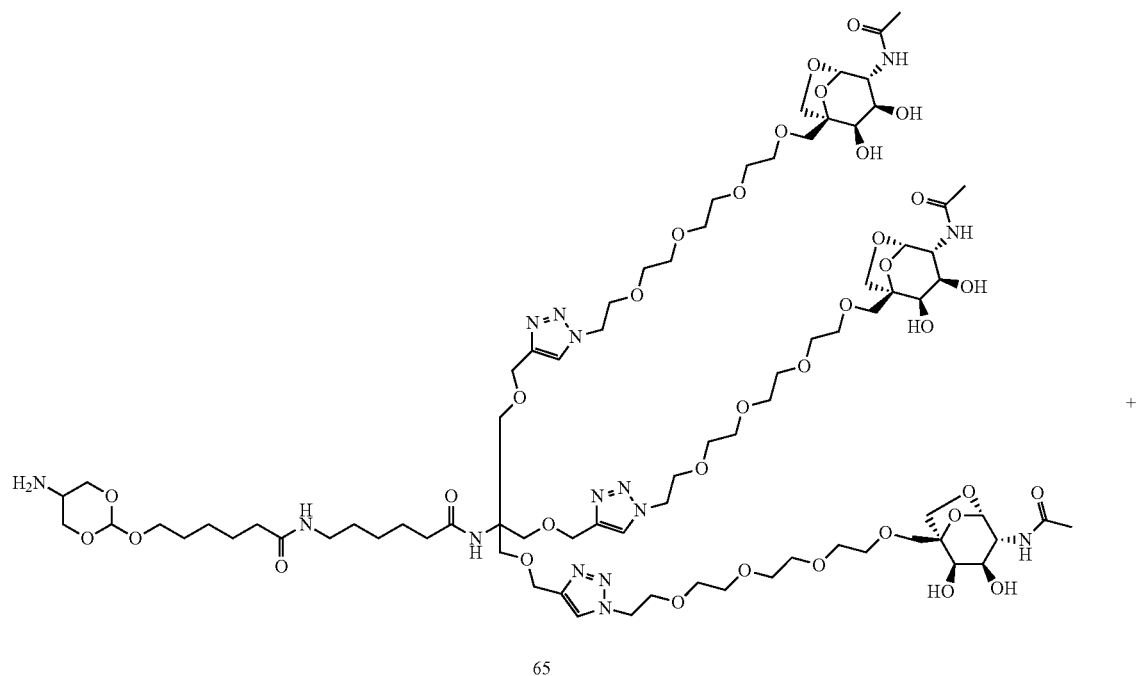
65
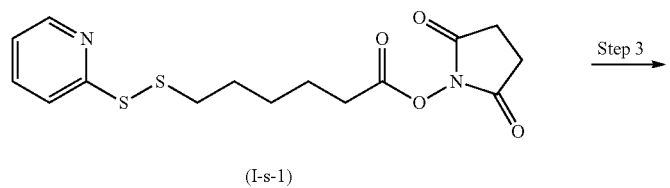
(I-s-1) Step 3
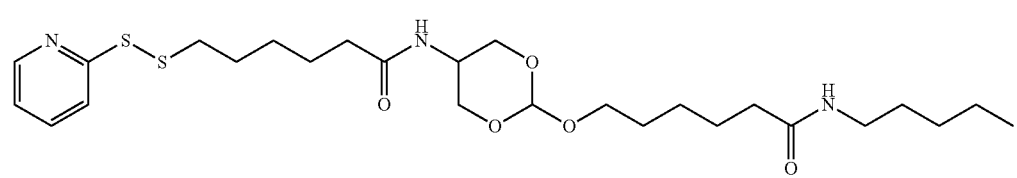

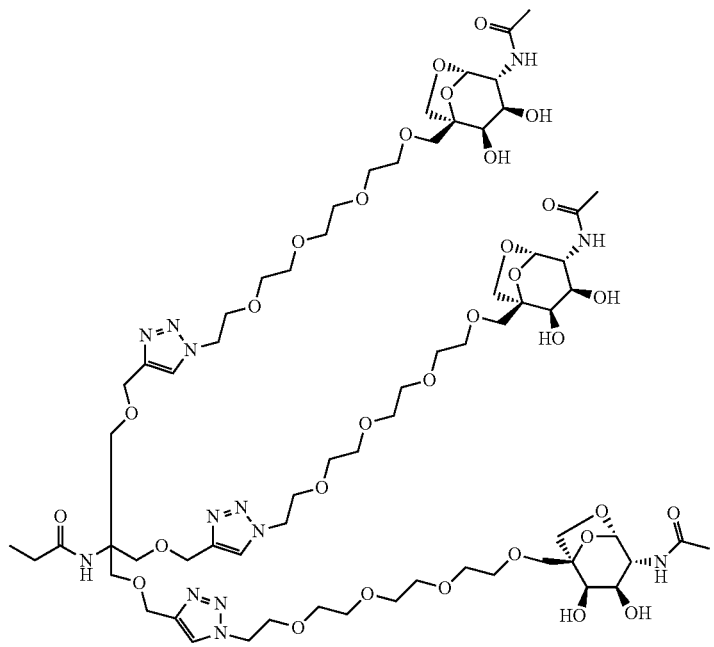
66
In a similar fashion, as shown in Scheme 5, compound (66) could also be synthesized by one skilled in the art utilizing (I-av-1) and an appropriate alcohol such as (I-an-1) using reaction conditions described previously for Scheme 4.
Scheme 5.
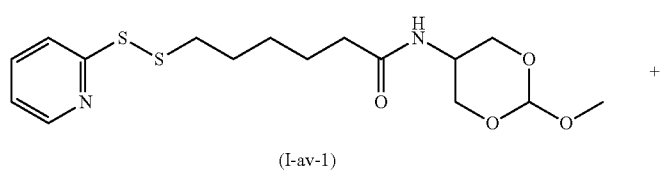
(I-av-1)
+

-continued
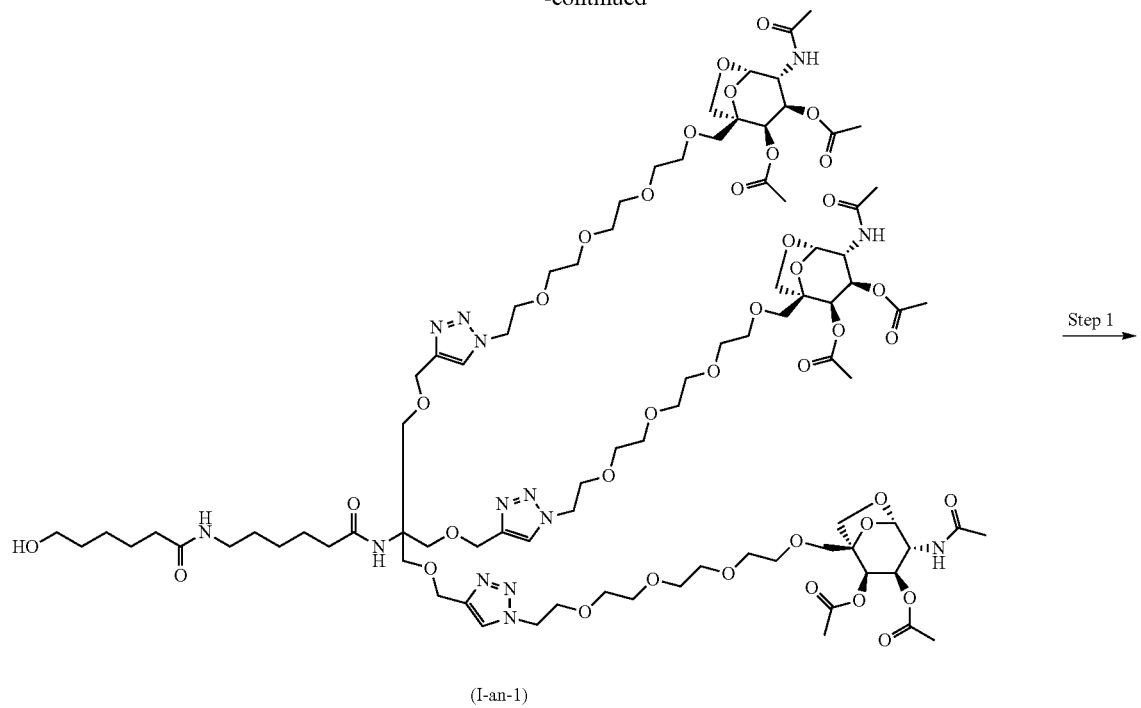
(I-an-1)
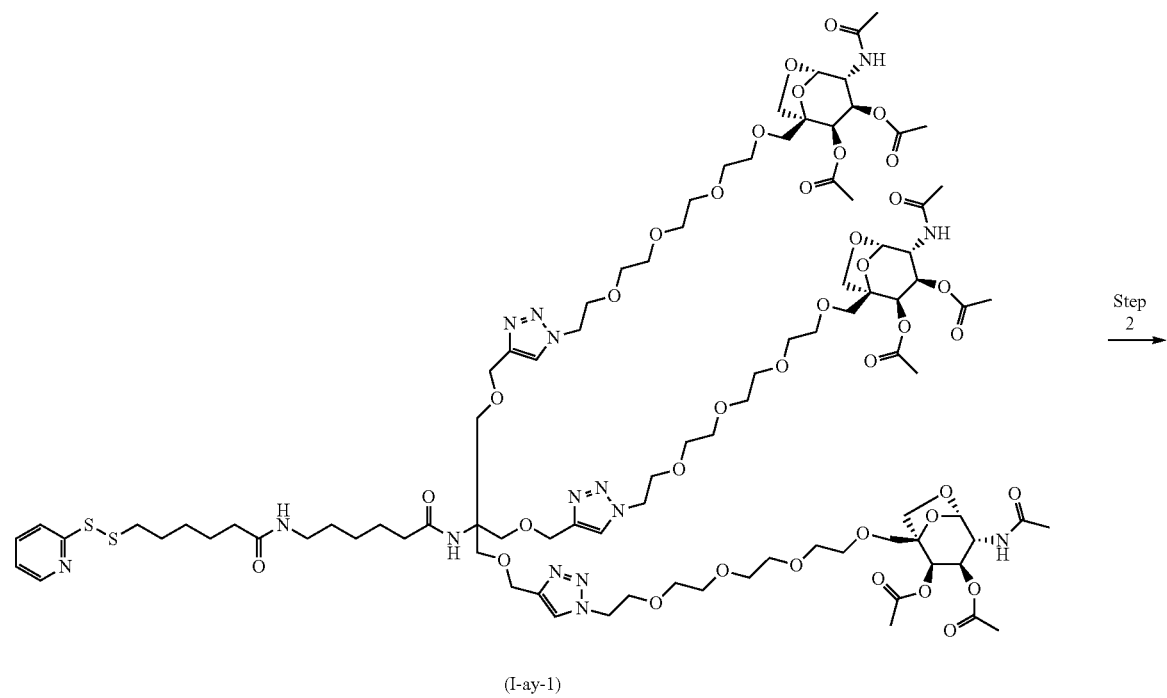
(I-ay-1)
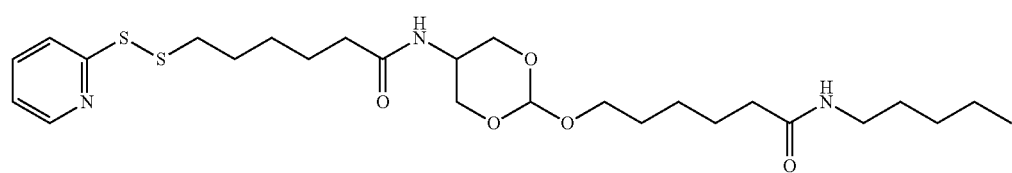

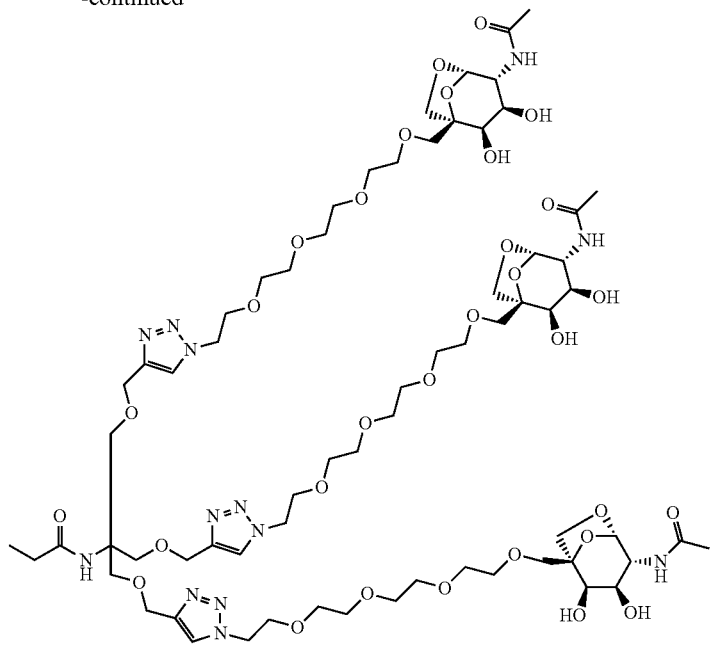

66

N-(1,3-dihydroxypropan-2-yl)-6-(pyridin-2-yldisulfanyl)hexanamide (I-au-1)

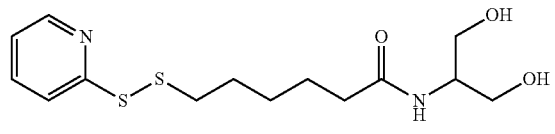 [SMILES: O=C(CCCCCSSc1ccccn1)NC(CO)CO]

To a solution of 1-{[6-(pyridin-2-yldisulfanyl)hexanoyl]oxy}pyrrolidine-2,5-dione (I-s-1) (518 mg, 2.01 mmol) in N,N-dimethylformamide (7 mL) was added N-(3-dimethylaminopropyl)-N'-ethylcarbodimiimide hydrochloride (463 mg, 2.42 mmol) and 1-hydroxybenzotriazole (326 mg, 2.42 mmol) and stirred for 1 hour at room temperature. After 1 hour, 2-aminopropane-1,3-diol (183 mg, 2.01 mmol) was added followed by N,N-diisopropylethylamine (1.05 mL, 6.04 mmol). The reaction was allowed to stir overnight at room temperature. After 18 hours, the reaction was diluted with water and extracted with three times with dichloromethane. The combined organic layers were washed with brine, dried over magnesium sulfate, filtered and concentrated under reduced pressure. The crude material was purified using the CombiFlash Rf (RediSep 24 g silica gel column) and eluting with a gradient of 0-20% methanol/dichloromethane yielding the title compound (368 mg, 55%). Method C: 1.5 minute run LRMS [M+45 (formic acid)=375]. $^1$H NMR (METHANOL-$d_4$) δ: 8.38 (d, J=4.3 Hz, 1H), 7.84-7.89 (m, 1H), 7.77-7.83 (m, 1H), 7.21 (t, J=5.7 Hz, 1H), 3.92 (quin, J=5.5 Hz, 1H), 3.51-3.70 (m, 4H), 2.82 (t, J=7.2 Hz, 2H), 2.21 (t, J=7.4 Hz, 2H), 1.71 (quin, J=7.3 Hz, 2H), 1.60 (quin, J=7.5 Hz, 2H), 1.37-1.51 (m, 2H)

N-(2-methoxy-1,3-dioxan-5-yl)-6-(pyridin-2-yldisulfanyl)hexanamide (I-av-1)

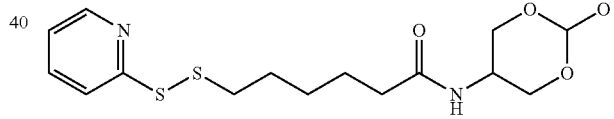

To a mixture of N-(1,3-dihydroxypropan-2-yl)-6-(pyridin-2-yldisulfanyl)hexanamide (I-au-1) (280 mg, 0.847 mmol) in dichloromethane (0.605 mL) and trimethylorthoformate (0.5 mL, 5 mmol) was added p-toluenesulfonic acid monohydrate (1.78 mg, 0.00847 mmol). The reaction was allowed to stir at room temperature for 3 hours. After 3 hours, the TLC showed the almost complete consumption of the starting material. The reaction was diluted with dichloromethane and washed with saturated sodium bicarbonate aqueous (3×1 mL), brine (1 mL), dried over anhydrous potassium carbonate, filtered and concentrated under reduced pressure yielding the crude title compound (263.0 mg, =83.3%). Method C: 3 minute run (basic mode: Column: Base: Waters Acquity UPLC BEH, 2.1 mm×50 mm, C18, 1.8 μm; Mobile phase: A: 0.1% ammonia in water (v/v); B: 0.1% ammonia in acetonitrile (v/v)) LRMS [M+45=417]. 1:1 mixture of cis/trans isomers:

Isomer 1: $^1$H NMR (METHANOL-$d_4$) δ: 8.41 (d, J=4.7 Hz, 1H), 7.86-7.92 (m, 1H), 7.80-7.86 (m, 1H), 7.20-7.27 (m, 1H), 5.31 (s, 1H), 4.29 (d, J=2.7 Hz, 1H), 3.92-3.96 (m, 1H), 3.83 (br. s., 1H), 3.63 (d, J=5.1 Hz, 1H), 3.59 (dd, J=11.5, 3.7 Hz, 1H), 3.42 (s, 3H), 2.85 (t, J=7.2 Hz, 2H), 2.21-2.30 (m, 2H), 1.68-1.80 (m, 2H), 1.56-1.67 (m, 2H), 1.39-1.53 (m, 2H)

Isomer 2: $^1$H NMR (METHANOL-d$_4$) δ: 8.41 (d, J=4.7 Hz, 1H), 7.86-7.92 (m, 1H), 7.80-7.86 (m, 1H), 7.20-7.27 (m, 1H), 5.27 (s, 1H), 4.26 (d, J=2.7 Hz, 1H), 3.92-3.96 (m, 2H), 3.86-3.91 (m, 1H), 3.59 (dd, J=11.5, 3.7 Hz, 1H), 3.38 (s, 3H), 2.85 (t, J=7.2 Hz, 2H), 2.21-2.30 (m, 2H), 1.68-1.80 (m, 2H), 1.56-1.67 (m, 2H), 1.39-1.53 (m, 2H)

Pharmacological Data

The practice of the invention for the treatment of diseases modulated by targeting the asialoglycoprotein receptor (ASGPR) using compounds of the invention can be evidenced by activity in one or more of the functional assays described herein below. The source of supply is provided in parenthesis.

Surface Plasmon Resonance Measurements

Preparation of Biotinylated ASGPR:

ASGPr H1 wild type was expressed as an insoluble inclusion body (IB) in *E. coli*. The cell pellet was re-suspended in TBS buffer pH 8.0 with 0.1 mg/mL lysozyme+25 microg/mL DNase+10 microg/mL RNase+10 mM MgCl2 and stirred on ice until well blended. The mixture was passed through a microfluidizer twice and centrifuged 30 minutes at 30,000×g. The resultant IB pellet was washed with TBS buffer pH 8.0+3M urea and centrifuged and this process was repeated three additional times with water. The IB pellet was solubilized in 10 mM Tris+8M urea+100 mM β-mercaptoethanol (pH 8.5), stirred for approximately 20 minutes, then centrifuged to discard any precipitate. For the following manipulations, "buffer T" refers to 20 mM Tris+0.5 M NaCl+25 mM CaCl$_2$. The supernatant was diluted to approximately 0.5 mg/mL in buffer T+2 mM β-mercaptoethanol+8M urea (pH 8.0), then dialysed vs. 8-10× excess volume of buffer T+2 mM β-mercaptoethanol+2 M urea (pH 8.0) overnight at 4° C. Dialysis was repeated in buffer T+1 mM β-mercaptoethanol+1 M urea (pH 8.0) for approximately 24 h at 4° C. with several volume changes with a final dialysis vs. buffer T+5 mM GSH+1 mM GSSG (pH 7.5) with 3 volume changes. The resulting sample was centrifuged and the supernatant was loaded onto an N-acetyl-D-galactosamine agarose packed Pharmacia XK 26 column, equilibrated in buffer T+2 mM TCEP (pH 8.0). The column was washed with this buffer until baseline was re-established. The bound protein was eluted with 20 mM Tris+0.5 M NaCl+2 mM TCEP+2 mM EDTA (pH 8.0). The final yield was approximately 50 mg from 5 L (70 wgm.) *E. coli* cell pellet. While BSA has one cysteine (Cys34) not engaged in disulfide bonding, this thiol group is often blocked as a mixed disulfide with small thiols such as cysteine, or as the sulfenic acid by aerobic oxidation. Disulfide reduction and labeling were found to be the cleanest method for derivatization of the ASGPR binding domain among those that we tested. Mild disulfide reduction conditions were chosen so as not to disrupt buried intra-strand (solvent inaccessible) crosslinks. Thus, immediately prior to biotinylation, the ASGPR sample was first incubated with 1 mM TCEP to ensure that the sample contained a single free thiol. The protein was reacted with a 19-fold molar excess of Pierce Maleimide-PEG2-biotin reagent in PBS overnight at 4° C.

Excess biotin was removed from the sample using either PD-10 columns (GE Healthcare) or Zeba Spin Desalting columns (Thermo/Pierce) using manufacturer protocols. LC-MS analysis of the product verified the presence of a single mass with addition of 525 amu consistent with the molecular weight of the maleimide adduct. Since TCEP was present throughout the maleimide reaction, if the protein had been fully reduced (making other cysteine thiols available), the result would have been a heterogeneous product containing multiple adducts, and probably misfolding or precipitation upon removal of key structural disulfide linkages. No such outcomes were observed. Furthermore, the observation of standard binding specificity (GalNAc vs. methyl galactoside vs. lactose) strongly suggests that enough of the protein on the SPR chip was properly folded and displayed.

SPR Binding Measurements:

All SPR measurements with compounds were performed using a Biacore 3000 (GE Healthcare) at 25° C. Biotinylated ASGPR was immobilized typically at 2000-3000 resonance units (Ru) using either SA sensor chips (GE Healthcare) or custom sensor chips with Neutravidin (Pierce Biochemical) immobilized by standard amine coupling to CM5 sensor chips (GE Healthcare). The running buffer was HBS (10 mM HEPES, 150 mM NaCl), 20 mM CaCl$_2$, 0.01% p20, 3% DMSO or 50 mM tris, 150 mM NaCl, 50 mM CaCl2, 0.01% p20, 3% DMSO pH 7.5. Compounds were diluted into running buffer at a concentration of 900 uM and serially diluted 3 fold to 3.7 uM. Compound solutions were injected at 50 ul/min for 1 min followed by a 1 min dissociation in duplicate for each concentration. For the multimeric conjugates (dimers, trimers), the conjugates were diluted in running buffer to concentrations of 100 nM or 10 nM and serially diluted. Conjugates were injected for 2 min and off rates were detected for 300 or 600 sec. After completion of off phase data the compounds were displaced using an injection of 900 uM GalNAc returning the receptor surface to the free state. All data was processed using Scrubber2 (Biologic Software, Inc.) to zero, align, reference and correct for excluded volume effects. $K_D$s were determined by fitting the steady state binding responses for the compounds and single conjugated molecules in Scrubber2. $K_D$ for multimeric conjugates showing kinetic responses were processed in Scrubber2 and fit in BiaEval (GE Healthcare) to extract the on and off rate parameters in order to calculate $K_D$. Values reflect standard deviations from multiple experiments.

The following results were obtained for the SPR binding assay wherein each run is separately reported or the number of runs (n) and standard deviation is noted:

| Compound No. | $K_D$ (microM) |
|---|---|
| 3 | 7.18 (n = 54 and std dev = 2.13) |
| II-b | 199 |
|  | 240 |
|  | 260 |
|  | 300 |
| 1 | 9 |
| 18 | 3.1 |
|  | 2.3 |
|  | 2.8 |
|  | 3.8 |
| 17 | 5.3 |
|  | 3.4 |
|  | 2.6 |
| 20 | 2.18 |
|  | 3.8 |
|  | 4.2 |
| 19 | 3.3 |
|  | 3.2 |
|  | 3.2 |
|  | 7.7 |
| 21 | 3.4 |
|  | 1.8 |
| 22 | 5.5 |
|  | 7.2 |
|  | 6.7 |
| 10 | 3.9 |
|  | 4.1 |
| 11 | $1.09 \times 10^{-3}$ |
|  | $0.8 \times 10^{-3}$ |
|  | $1.18 \times 10^{-3}$ |
| 12 | $0.097 \times 10^{-3}$ |

| Compound No. | $K_D$ (microM) |
|---|---|
|  | $0.084 \times 10^{-3}$ |
|  | $0.120 \times 10^{-3}$ |
|  | $0.220 \times 10^{-3}$ |
| 25 | 2.2 |
|  | 3.0 |
|  | 2.7 |
|  | 3.2 |
|  | 4.3 |
| 24 | 1.1 |
|  | 2.0 |
|  | 2.3 |
|  | 1.4 |
|  | 0.7 |
|  | 0.8 |
|  | 1.6 |
|  | 1.4 |
| 26 | 60 |
|  | 96 |
|  | 140 |
|  | 110 |
|  | 149 |
|  | 117 |
| 29 | 6.9 |
|  | 11.6 |
|  | 8.8 |
|  | 15.9 |
|  | 11.7 |
|  | 6.4 |
| 30 | 110 |
|  | 83 |
|  | 210 |
|  | 240 |
|  | 132 |
|  | 192 |
| 27 | 0.7 |
|  | 1.9 |
|  | 1.2 |
|  | 1.0 |
|  | 1.5 |
|  | 0.5 |
| 28 | 1.2 |
|  | 1.8 |
|  | 2.1 |
|  | 1.4 |
|  | 2.4 |
|  | 2.9 |
| 31 | 12.3 |
|  | 12.3 |
|  | 14 |
|  | 10.6 |
|  | 15.6 |
|  | 17.3 |

Throughout this application, various publications are referenced. The disclosures of these publications in their entireties are hereby incorporated by reference into this application for all purposes.

It will be apparent to those skilled in the art that various modifications and variations can be made in the present invention without departing from the scope or spirit of the invention. Other embodiments of the invention will be apparent to those skilled in the art from consideration of the specification and practice of the invention disclosed herein. It is intended that the specification including the examples be considered as exemplary only, with a true scope and spirit of the invention being indicated by the following claims.

SEQUENCE LISTING (847 sequences)

SEQ ID NO: 1 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 2 - protein, 1368 aa, Streptococcus pyogenes [sequence omitted]

SEQ ID NO: 3 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 4 - protein, 1368 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 5 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 6 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 7 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 8 - protein, 1368 aa, Streptococcus pyogenes; identical to SEQ ID NO: 4

SEQ ID NO: 9 - protein, 131 aa, Helicobacter hepaticus
MRILGFDIGITSIGWAYVESNELKDCGVRIFTKAENPKNGDSLAAPRREARGARRRLARRKARLNAIKRLLCKEFELNLNDYLANDGELPKAYQTSKDTKSPYELYTAFHWIIFAFCSIASSLSNRQMLPI

SEQ ID NO: 10 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 11 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 12 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 13 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 14 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 15 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEEGALAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 16 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 17 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 18 - protein, 1122 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 19 - protein, 1128 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKRLRLQIKQNISNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 20 - protein, 1123 aa, Francisella tularensis
MNVKILPIAIDLDVKNTGVFSAFYQKGTSLEKLDNKNGKVYELSKDSYTLLMNNRTARRHKRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILGTLLTDDFDIWNFNFEKFDFDKNEEKLQNQEDKDHTQAHLHHFVFVVNKIKSEMASGGRHRSQYFQEITNVLDENNHQEGYLKNFCENLHNKKYSNLSVKNLVNLVGNLSNLELKPLRKYFNDKIHAKADHWDEQKFTETYCHWILGEWRVGVKDQDKKDGAKYSYKDLCNELKQKVTKAGLIDFLLELDPCRTIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDNNQLLTYCNHKPRQKRYQLLNDLAGVLQVSRNQLLSSVEEWFQQAQRVGEISKSQDEQIFEWLKSFKIASYCKAAVEMQKQYRGTLKNAIQTAIFRQSENINKNKNTGNQQQALSENSKDVKSLTADEKKLLKLIENIAKASQKIGESLGLNDKQIKKFNSIYSFAQIQQIAFAKRKGNANTCAVCSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNIFAIDTSKWFEIETPSDLRDIGVATIQYKIDNNSRPKVRVKLDYVIDDDSKINYFMNHSLLKSRYPDKVLEILKQSTIIEFESSGFNKTIKEMLGMTLAGIYNETSNN

SEQ ID NO: 21 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 22 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 23 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 24 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 25 - protein, 1370 aa, Streptococcus agalactiae; identical to SEQ ID NO: 5

SEQ ID NO: 26 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 27 - protein, 997 aa, Maritimibacter alkaliphilus
MKVLVDAGLMPSDPAAAKALETLDPYELRATGLDVMLPLTHLGRAVFHLNQRRGFKSNRKTDRGDNESGKIKDATKRLTWAMQEAGARTYGEFLHMRRARASDPRQVPSVRTRLSVASRGGPDSKEEAGYDFYPERAHLEDEFHALWSAQAAFHPDLTCELRDVVFEKIFYQRPLKEPKVGLCLFTAEERLPKAHPLTGRRVLYETVNQLRVTADGRTTRPLTLEERDMIVYALDNKKPVKSLSSMHLKLVALGKLVKLKDGERFTLESGVRDAIACDPIRATMGHPDGFGPAWSRLDWQAQWALIEKLRQVQSDDDFASLVAWLGATHNLSEDHAKRVANLHLPEGYGRLGLTATEAILCNLKAEVCTYSQAVERWGKHHSNQRTGECLEALPYYGEVLDRHVIPGTYNEDDDDVTRYGRITNPTVHIGLNQLRRLVNRIIATYGKPDQIVVELARELKQSEAQKSEALKKIRDTTADAIRRGRQLEEIGQKNTGANRLLLRLWEDLGPAVGPRCCPYTGKPISVTMLFDGACDVDHILPYSRTLDDSFANRTICLREANRQKGDRTPWEAWGGSDQWDAIEANLKDLPENKRKRFAPDAMERFEGERDFLDRALVDTQYLARISRAYLDTLFTEGGHVWVVPGRMTEMLRRHWGLNALLSDKDRGAGKVKNRTDHRHHAIDAAVIAATDHSLVNRISKAAGQGESAGQSAELIARDTPEPWEGFRNDISAQIARIVVSHRADHGRIDVEGRKHGKDSTAGRLHNDTAYGIVDDHTVVSRTPLLSLKPGDIEVTTKGKNIRDTQLQKALSVATTGKDGKGFEEALRNFAEKEGPYQGIRRVRLIETLQSSARVEVGSDEDGQPLKAYKGDSNHCYDLWKLPDGKVVPHVVSTYEAHAGTDKRPHPAAKRILRVFKKDMVAIEQDDQTAIFYVQKLDRANGLFLAPHLEANADARHRNPNDAFKFLQMGAGSVVRNKLRRVYVDEIGRIKDPGPPKH

SEQ ID NO: 28 - protein, 1027 aa, Blastopirellula marina
MFSESGDQPSLVDCGVRIFPEGVERDQQGGEKSKSQSRRVARGIRRQVRRRAQRLRHLKHALITTGLFPADVVDQQEVLASNPYELRSRALSEKLEPYEIGRILLHLAKRRGFLSNRTTDRSGGNELKGILAEMTQLQGEIAAHGCQTLGQYLHQLGDDGETFAQRLRGRHTLRAMYEDEFEKIWERQASYYPALLTEELRGGEEGKQSYPLVPTARRKSESLLKRFGLHGLLFFQRKMYWPKSVIGRCDLEPKEKRCPKADRLAQRFRILQEVNNLRLISPADRKEYTFAEFVGAGADKKLVDYLCEAKERTFPQIRKKFKLPETISFNYERGERSKLQGHETDAHFNGKKGLGKRRWSEIAEDVKDHIIQIVLEEDREDVALRKLTQDCSLTVEEAHKAMALHLPAGYSQYSRVAISRLLPHLELGKLLMGNDASDSAMHAAGYLRPDEREVRQYDLLPEPPDIPNPLVRQALYEVRKVINAIIREYGALGTIRVELAREAKKSAEQRTQIRIANAKRERENAAIAKTLQEMSPAIRPTRRNIQRYLLWKDQGGVCIYTGKVISQAQLFDSGEVDVDHILPRWRSLDDSMANKVIAHRSANNEKGDRTPWEWLGHDKPRFDELLLRAQRLPYGKRQRFIQKEVELTNFVERQLRDTTYVSRLVVQYLKGLGVPITTVKGPMTAELRHHWGLNALLNEDGSQKKNRSDHRHHAIDAIVIGLTDAKRLHALANARGKDLQPPWSEFRSDVATALGRMAVSHRVRRRIQGALHEETIYGPTQKAAQPTSTDQRPWAKDWIEDSQIVVRRKSVSDLTNTKHLAKIRDVTIRKILEDHLRRQKVDPTKPGVIPKDAFAGSNAPQMPSGVPIKKVRLVERGETWRKIGSGEASKFIKPGSNHHISYFAISRKGRESWKAHVTIMLDAACIAKESINNGKIVNRSIGDQGRFLMSLSIGEMFEITNNGGEILLCVVRKIDQSGRIYYKIHDDARESMDLKKDNLYMSPSKMQQFDARKVTVTPLGKIRNAND

SEQ ID NO: 29 - protein, 158 aa, Francisella tularensis
MIDFLLELDPCITIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLSEIYFQAKKLKQKASSELEKLESSKKLDEVIANSQLS

SEQ ID NO: 30 - protein, 393 aa, Francisella tularensis
MNVKILPIAIDLDVKNTGVFSAFYQKGTSLEKLDNKNGKVYELSKDSYTLLMNNRTAQRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQSQEDKDHTQAYFHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 31 - protein, 1066 aa, Rhodopseudomonas palustris
MSERVVRRILGIDLGIASCGWGVVDISGAGGGIIATGVRCFDAPLIDKTGEPKSATRRTARGQRRIVRRRRQRMNGVRRLLCEFGLLPDPRPDALNQAMRRISTASAAAQVTPWTLRAAAHQRLLSNEELAVVLGHIARHRGFRSNAKNEAGANAADETSKMKKAMEATREGLAKYHAFGDMIANDPKFANRKRNRDKDYSHTAKRSDLEDEVRAILRAQLRFGSAAATETLAQTFADVAFFQRPLQDSEDRVGDCPFEPGQKRAARRAPSFELFRFLSRLANLKLAVGRSPERRLTAEEIALAAKGFGETKKTITFKSLREALDLDPNARFSGIGKDKEASLDVVARTGGAAYGTKTLKDALGDAPWRSLSRTPETLDRIAEILSFREDITSIRNGLEDLGLDSLVVEALMQAAANGDFKEFTRAGHISARAARNIIPGLREGLVYSEACARVGYDHAARLSVPLDQVGSPVTRKALSEALKQVRAVAREYGPIDYFHIELARSVGKSAEERKQLTDGIEARNVEKAKRRKQAEEHLGRAPSDDELLRYELAKEQNFKCIYSGDAIDPAGVAANDTRYQVDHILPWSRFGDDSYLNKTLCTARSNQNKRGRTPFEWFEADKTDVEWMEYVARVENLQEVKGRKKRNYSIKDAAAIEDKFKARNLTDTQWATRLLADELSRMFPPRECERAICGRADGGNDGLTIVEERRVFTRPGAITSKLRRAWGLEGLKKQDGKRVEDDRHHAVDALVLAATTESLLQRLTVEVQRREREGRPDDIFHCAEPWRGFRADVRRTVYGSETMPGIFVSRAERRRARGKAHDATIKQIREIEGERLVFERKPVEKLTDKDLEKIPIPKPYGQVSDPKRLRDELVESLRAWIAAGKPKDRPPLSPKGDVIRKVRIQTNDKVSVEINGGTVDRGDMARVDVFRKKNKKAVWEYYVVPIYPHQIVALNDPPDRAVIAYAEDKDWKEIDSSYEFLWSLFGLSYVEISKANGECIDGYFRGLHRGTGAASVCKHISLGKDATVSGIGLKTLASFKKFTIDRLGRKFEIPREVRTWRGEACT

SEQ ID NO: 32 - protein, 1149 aa, Lactobacillus salivarius
MERYHIGLDIGTSSIGWAVIGDDFKIKRKKGKNLIGVRLFKEGDTAAERRGFRTQRRRLNRRKWRLKLLEEIFDPYMAEVDKYFFARLKESNLSPKDSNKKYLGSLLFPDISDSNFYDKYPTIYHLRRDLMEKDKKFDLREIYLAIHHIVKYRGNFLEKVPAKNYKNSGASIGFLLEEVNDLYGNIIGNEDVAILDNDKFEDVEKIILNDEIRNIDKQKNVGRLLVKDKKEKNIVTAFSKAIFGYKFNLEDLLLIESDEKNKLTFNDENIDDIFNELSHSLNDNQMDLLTKTREIYFKFKLNMIVPTGYTISESMIEKYEMHKAHLKMYKEFINTLNAKDRKILKNAYSDYINNEKAKAANAQENFYKTVKKTIKENDSDTAKKIIGLIDEGNFMPKQRTGENGVIPHQLHQIELDRIIENQAKYYPWLAEENPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKYKVLNELNNIKVNKKKLDVEQKQHVYLDLFTTRKNVTKDDLATSLNCDVESITGLTDNKKFNSSLSSYIDLKAILGNIVDDYSKNEDLEKIIEYSTIFEDGNIYKEKLSEISWLTDEQIEKLSNIHFKGWGRLSKKLLTQITNENGERIIDTLWNTSNNFIQVISDESIQAKLAEINGEYANKYNLEDILDEAYTSPQNKKAIRQVMKVVEDIEKAMKCEPTSIAIEFTREKRKSKLTNTRYKKISETYEKITDELISEYELGKLQSELDSKVNNMRDRYYLYFMQLGRDMYTGEKMNIDELHQKYDIDHILPQSFIKDDSLNNRVLTSKSVNIKEKSDKTAADLYAAKMGDFWRKLRKQGLMTEQKYKNLLTRTDSINKYTKQSFIKRQLVETSQVVKLAANILQDKYRNTKIIEIRARLNSDLRKKYELIKNREVNDYHHAIDGYLTTFVGQYLYKVYPKLRSYFVYDDFKKLDSNYLKHMDKFNFIWKLEDKKAEDVYDKVNDEFVLNVPEMKEYIRKIYNYKYMLVSKEVTTKNGAFYDQTKYNAKTINLIPIKKDKPTNIYGGYKGKVSSYMMLVKIQKKKEVIYKFVGVPRLWTDELDRLIDTDEKKALLKK

SEQ ID NO: 33 - protein, 1064 aa, Rhodopseudomonas palustris
MSECVTRRILGIDLGIASCGWGVIEVGEASGSIIASGVRCFDAPLIDKTGEPKSATRRTARGQRRIIRRRRQRMNAVRRLLAEFGVLTGRSPDALHQALLRLSQSVAGSQVTPWTLRAAAHERKLTNDELAVVLGHIARHRGFRSNSKNDGGANAADETSKMKKAMETTREGLARYHSFGAMIASDPKFADRKRNRDKDYSHTAKRSDLEDEVRTIFRSQTRFGSLVASEKLSQAFADAAFFQRPLQDSEDMVGSCPFEPGQKRTARRAPSFELFRFLSRLANLKLTVGRAPERRLTPDEIALAAKGFGETKKSITFKSLREALDLDPNARFSGVAKEKESTLDVAARTGGAAYGTKTLKDALGDAPWRSLSRMPEKLDRIAEILSFREDMKAIRNGLEEVGLDGLVVDALMQATANGDFKDFTRAAHISALAARNIIPGLREGLVYSDACTRVGYDHAARPAVPLSQIGSPVTRKALSEALKQVRAVAREYGPIDYFHIELARSIGKSAEERKKLTDGIEARNVEKEKRRKEAAEHLGRAPSDDELLRYELAKEQNFKCIYSGDPIDPAGISANDTRYQVDHILPWSRFGDDSYVNKTLCTARSNQNKRGRTPFEWFDADKTEAEWMEYSARVEDLKEVKGRKKRNYSIKDAASVEDKFKARNLTDTQWATRLLADELKRMFPPRECERVVTVRADGGNDGLSIVEERRVFTRPGAITSKLRRAWGLEGLKKQDGKRVEDDRHHAVDALVLAATTESLLNRLTVEVQQREREGRQDDIFHCSQPWPGFRVDVQRTVYGSETMPGIFVSRAERRRARGKAHDATVKQIRDIDGERIVFERKPIEKLTDKDLERIPVPEPYGKAADPKKLRDELVENLRAWIAAGKPKDKPPRSPKGDIIRKVRIETKDKVAVEINGGTVDRGDMARVDVFRKKNKKGVWEFYVIPIYPHQIVASALPPNRAVIAYKAESEWTAIDGCFEFAWSLNPMSYLELVKSNGELIEGYFRSMDRTTGAINLSPMSTNSETIRSIGVKTLSSFRKFTVDRLGRKFEIPREVRTWRGEACT

SEQ ID NO: 34 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 35 - protein, 641 aa, Nitrobacter hamburgensis
MHKRNSRSYRLGLDLGSNSLGWFVTHLEKRGDRYEPVALDPGGVRIFPDGRDPQSGMSNAVDRRMARGARKRRDRFVDPYALRKAALTNALPAHRVGRAIFHLNQRRGFQSNRKTDRKQSEDGAIKQAASKLKARMHEEAAPTLGAFFADMHLRKSYDDQQTAIRAELVRLGKDHLTGNARKKVWAKVRKRLFGDEVLRPKDTSDGARARATTTGTKASYDFYPTRAMLLDEFNAIWAAQREHHLAMTDEAKAEIEHIIFYHRPLKPAIVGKCTLDPATRPFKEDPEGYRAPWSHPLAQRFRILSEARNLEIRETGKTSRRLTKDQSDLVVAALLANREVKFDKLRTLLKLPAEARFNLESDRRSTATRPPHGCRTRRASIRRGAGFLRNGRSRSSPDWKKPKTKTNCSHGSKWNAHLTAQRPRASPIRRCRTAIAGSACAQSKRSCRSCRTSSMRMALRAPAITSWPSVPATTIPVDTFQQGGNAFGRILSVVTIELFAITDRVDPVQEQDARCFALRIAECRSDGLQHFAEVSLGLPPRNAAQDQRHSAGLCQSSCVGRFVPGTPCRRTPRSTSLHGKEPSAHAFGSTARSRPQLPASPRPCMSFRDGTSSSPARMPETLDRCAISRSNRSSVCRAERL

SEQ ID NO: 36 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 37 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 39 - protein, 1371 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGSD

SEQ ID NO: 40 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 41 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 42 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 43 - protein, 1629 aa, Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 44 - protein, 1068 aa, Verminephrobacter eiseniae
MNKAVAYRLALDLGSTSLGWAIFRLNEAREPTAIIRAGVRIFSDGRNANSEPLAVHRRVARAMRRRRDRLLKRKKRMHDQLVQHGFFPAEVAERKELERLNPYQLRAKGLHEALTPGEFARALFHINQRRGFKSNRKTDRKDNDSGALKQAISELRKRIQDSDCATAGEWFWKERMQQKPEGVRGQWVRARYRKTPSTTDEGKKRIGYDLYVDRAMVEQEFDALWAAQAALQPGLFTEAARAELKDTLLYQRDLRPVKPGRCTLLPAEERAPLALPSTQRFRILQEVNNLRLLDEALREVPLNLAQRDAVVSALEGKKELSFAAIRKLLTLSGKFNLEDEKRAELKGNATSVILARKDLFGDAWAGFDAAVQDEIVWRLVSQESEGALIAWLQQHTGVDGVCAEAIVNTRLPDGYGRLSRKALERIVPALQREVCTYDKAVQAAGFAHHSDLGFDFDYAEDEVQQVGEHTIASTGEVQAQYAFKQLPYYGKALQRHVAFGSGDAKDHEEKCYGKIANPTVHIGLNQVRTVVNALIRRYGHPTEVVVELARDLKQSREQKQQTQREQADNQKRNEDIRKRIAPILETSPERVRDRDIKKWILWEELNKKDIADRHCPYSGERISATMLLSEAVEIEHILPFSRTLDDSLNNRTVAMRRANRIKGDRTPWEARADFEAQGWRYEAILQRAEGMPPRKRYRFAEDGYQRWLGKDRNFLARALNDTSYLSRLAANYLRLVCPQGVRVIPGQMTDKLRGKFGLNSVLGLDGKKNRNDHRHHAVDACVIGVTDQGLMQRFANASKQARENGLTRLVQDMLLPWWPSYYDHVERAVRHIRVSHRPDHGFEGAMMKGTAHGIREDGIREDGRIKQRPKAKGSADHKTITLIPIDEPRQLARHGVDAEGKPLPYKGYASGSNYCIEITKNGKGKWEGQVISTFDAYRIKAAADAAARAGQVISTVEADSIVRKSGWERLRGAQSQNGQPLVMRLVIGDSVRMEVDGRDEVMRVVKMSGKEMVFAPVREANVDKRNNMPDEQDPFTYTYKRADQLRKAKARQVTISPIGELRDPGFKG

SEQ ID NO: 45 - protein, 1125 aa, Francisella tularensis
MNVKILPIAIDLDVKNTGVFSAFYQKGTSLEKLDNKNGKVYELSKDSYTLLMNNRTARRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKIQKFSYTDKQGNLKELSYYHHDKYNIQEFLKRHATINDEILDTLLTDDFDIWNFNFEKFDFDKNEEKLQNQEDKDHTQAHLHHFVFAVNKIKSEMASGGRHRSQYFQEITNVLDENNHQEGYLKNFCENLHNKKYSNLSVKNLVNLVGNLSNLELKPLRKYFNDKIHAKADHWDEQKFTETYCHWILGEWRVGVKDQDKKDGAKYSYKDLCNELKQKVTKAGLIDFLLELDPCRTIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDNNQLLTYCNHKPRQKRYQLLNDLAGVLQVSRNQLLSSVEEWFQQAQRVGEISKSQDEQIFEWLKSFKIASYCKAAVEMQKQYRGTLKNAIQTAIFRQSENINKNKNKNTGNQQQALSENSKDVKSLTADEKKLLKLIENIAKASQKIGESLGLNDKQIKKFNSIYSFAQIQQIAFAERKGNANTCAVCSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNIFAIDTSKWFEIETPSDLRDIGVATIQYKIDNNSRPKVRVKLDYVIDDDSKINYFMNHSLLKSRYPDKVLEILKQSTIIEFESSGFNKTIKEMLGMTLAGIYNETSNN

SEQ ID NO: 46 - protein, 1064 aa, Unknown
  Bradyrhizobium sp.BTAi1
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 47 - protein, 1354 aa, Flavobacterium psychrophilum
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTSIYKAFEKILEVEGYEIDFSKMKPLEIKETVAPIFETLNINTVILDFDPTIQGNDFDKQPYYQLWHLLYSAEDDDKLKETLKTKFGFKENHLPFILNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKASDLFSKNYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLRQDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLGLSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 48 - protein, 1062 aa, Actinobacillus succinogenes
MNLNYILGLDLGIASVGWAVVEIDEQENPQRLIDVGVRTFDRAEVLKTGESLALARRLARSSRRLVKRRAERIKKAKRLLKAENLLLSADEILPNEAWQLRVKGLDQKLERQEWAAVLLHLLKHRGYLSQRKNESKSENKELGALLSGVAINHQILQSAEYRTPAEIAVNKFQAEEGHIRNQRGAYTHTFSRLDLLAEMELLFQRQATLGNPHTSTKLLENLTALLMWQKPALAGEAILKMLGKCTFEPTEYKAAKNSYSAERFVWLTKLNNLRILEQGAERALTDNERFALLDQPYEKAKLTYAQVRTLLGLSDEAIFKGLRYQGEDKKAVETKTTLMEVKAYHQIRKALEGLDLKAEWNELKNNPALLDEIGTAFSLYKTDDDIHRYLDGKLSESVLNALLENLNFDKFIQLSLKALQQILPLMLQGQRYDEAVSAIYGDHYGKKSDEIDRLLPNIPTDEIRNPVVLRTLTQARKVINAVVRLYGSPARIHIETGREVGKSYQDRKKLEKQQEENRKQRENAVKKFKEYFPNFVGEPKGKDILKMRLYELQQAKCLYSGKSLELYRLLEKGYVEVDHALPFSRTWDDSFNNKVLVLANENQNKGNATPYEWLDGKNNSEGWQHFVARVQTSGFSYAKKQRVLIQELDEKSFIERNLNDTRYVARFLCNHIADNMLLTGKGKRKVFASNGQITALLRGCWGLQKVRENNDRHHALDAVVVACSTKSMQDKITKFVKYKEGRLFKDKKDGVYKGERINRETGEIISLHFPTPWKFFKENVEIRIFSENPKLELENRLPDYPQYNHEFVQPLFVSRMPTRKMTGQGHMETVKSAKRLDKGLSVLKVPLTQLKLSDLERMVNREREMALYEALKECLEQFGNDPAKAFAEPFYKKGGALVKAVRVEQTQKSGVLVRNGNGVADNATGSIVRVDVFTKGGKYFLVPIYTWQVAKGILPNKAVIQGKDESEWEEMDENAVFQFSMHKNDLIKVKTKKGEIFGYFNGLDRATGSIEIEEHDLEKSKGKNGSHRGLGVKTAFFLEKYQVDELGKNIRPCRPTKRQHVR

SEQ ID NO: 49 - protein, 1340 aa, Dorea longicatena
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLKI

SEQ ID NO: 50 - protein, 984 aa, Campylobacter jejuni
MAKILAFDIGISSIGWAFSENDELKDCGVRIFTKAENPKTGESLALPRRIARSARKRLARRKARLNHLKHLIANEFKLNYEDYQSFDEILAKAYKGSLISPYELRFRALNELLSKQDFARVILHIAKRRGYDDIKNNGDEEKGKILKAIKQNEEKLANYQSVGEYLYKEYFQKFKENSKEFINVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTLYTKDDLNALLNEVLKNGTLTYKQTKKLLGLSDDYEFKGEKGNYFIEFKKYKEFIKALGEHSLSQDDLNEIAKDITLIKDEIKLKKALAKYDLNENQIDNLSKLEFKDHLNISFKALKLITPLMLEGKKYDEACNELTLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNTAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREEFKNELR

SEQ ID NO: 51 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 52 - protein, 1107 aa, Eubacterium ventriosum
MGYTVGLDIGVASVGVAVLDENDNIVEAVSNIFDEADTSNNKVRRTLREGRRTKRRQKTRIEDFKQLWETSGYIIPHKLHLNIIELRNKGLTELLSLDELYCVLLSMLKHRGISYLEDADDGEKGNAYKKGLAFNEKQLKEKMPCEIQLERMKKYGKYHGEFIIEINDEKEYQSNVFTTKAYKKELEKIFETQRCNGNKINTKFIKKYMEIYERKREYYIGPGNEKSRTDYGIYTTRTDEEGNFIDEKNIFGKLIGKCSVYPEEYRASSASYTAQEFNLLNDLNNLKINNEKLTEFQKKEIVEIIKDASSVNMRKIIKKVIDEDIEQYSGARIDKKGKEIYHTFEIYRKLKKELKTINVDIDSFTREELDKTMDILTLNTERESIVKAFDEQKFVYEENLIKKLIEFRKNNQRLFSGWHSFSYKAMLQLIPVMYKEPKEQMQLLTEMNVFKSKKEKYVNYKYIPENEVVKEIYNPVVVKSIRTTVKILNALIKKYGYPESVVIEMPRDKNSDDEKEKIDMNQKKNQEEYEKILNKIYDEKGIEITNKDYKKQKKLVLKLKLWNEQEGLCLYSGKKIAIEDLLNHPEFFEIDHIIPKSISLDDSRSNKVLVYKTENSIKENDTPYHYLTRINGKWGFDEYKANVLELRRRGKIDDKKVNNLLCMEDITKIDVVKGFINRNLNDTRYASRVVLNEMQSFFESRKYCNTKVKVIRGSLTYQMRQDLHLKKNREESYSHHAVDAMLIAFSQKGYEAYRKIQKDCYDFETGEILDKEKWNKYIDDDEFDDILYKERMNEIRKKIIEAEEKVKYNYKIDKKCNRGLCNQTIYGTREKDGKIHKISSYNIYDDKECNSLKKMINSGKGSDLLMYNNDPKTYRDMLKILETYSSEKNPFVAYNKETGDYFRKYSKNHNGPKVEKVKYYSGQINSCIDISHKYGHAKNSKKVVLVSLNPYRTDVYYDNDTGKYYLVGVKYNHIKCVGNKYVIDSETYNELLRKEGVLNSDENLEDLNSKNITYKFSLYKNDIIQYEKGGEYYTERFLSRIKEQKNLIETKPINKPNFQRKNKKGEWENTRNQIALAKTKYVGKLVTDVLGNCYIVNMEKFSLVVDK

SEQ ID NO: 53 - protein, 1136 aa, Streptococcus gordonii
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 54 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 55 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 56 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 57 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPAEPKAAKNTYTAERFIWLTKLNNLRILEQGSERPLTDTERTTLIDEPYRKSKLTYAQARKLLELDNTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIDLPPIPADEIRNPVVLRALSQARKVINGVVRRYGSPARIHIETAREVGKSFKDRKEIEKRQEENRKDREKAATKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 58 - protein, 1050 aa, Gluconacetobacter diazotrophicus
MGENMIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALTISAHNDPKSIHSGIGTKTLLAISKYQVDRFGRKSPVRKEVRTWHGEACISPTPPG

SEQ ID NO: 59 - protein, 1391 aa, Kordia algicida
MKKILGLDLGTNSIGWALVNEAEHEHEQSSIVKLGVRVNPLSVDEKTNFEKGRPLSINADRTSKRSARRNLQRFKLRRKNLINLLLKHHIISNETILTEVGKNTTHQTLKLRSKATQEKISLEEFARILLSINKKRGYKSSRKEKNEDEGFTIDGMAIAKELYDNQLTPGQYVYNILQDGKNYIPDFYRSDLQAEFDDVWQFQKKFYSSILTDEFYLKLKGQGKENTRKLFLAIHQVYTAENKGKRDAVKLQYYKWRSEAVKKQLSIEEVAYVLVEINNNINKSSGYLGAISDRSKALYFNNETVGEYLYGQLVKNRHNSLRNQVFYRQDYLDEFEKIWETQAKFYDELTNELKQEIRDVVIFYQRKLKSQKHLISDCLFEKHHKAIPKSSPLFQEFKIWQNLNYLEFVHTQSKEKIFFSELDDETRQFVFAELNIRGTLKIKEIKKLIGLETPVYWKSNFDEIEGNRTNQVLYNVYQNIADDLGYGFDWSKKHAFEINAELQAIFKDVGIDTAILNFDASIEENDFDKQKSYQLWHLLYSAEDTDKATEEDKLIYGNINTKLKKQLHQKYGFEAKYGNLLANISLQQDYGNLSAKAIKKILPYLESGNSFYEACTIVGYNPSNSLTKEQQQNRKLKDKLELLPKNSLRNPVVEKILNQKVNLINQLIDEYGKPDEVRIELARELKKSAKQRADLSKHINDATLKNQNIRKTLQKDFGIQNPSKNDVIRYKLYDELKDNGYKTLFTNKYIPKEQLFSKDVDIEHIIPKAILFDDSFSNKTLAYRNVNLAKADATAFDFISSKHLDDLDNYKARVETLFQSKRISKGKYKKLLMTRQNLPEDFIERDLRNSQYIAKKATAMLKEVFRSVVPTSGRITDKLREDWDLVNVMKELNLPKYRTLGLTEFIERKNGNKIEQIIDWTKRNDHRHHAMDALTVAFTTHNHIQYLNNLNVTHGLNGVDTDHEKSRLYAIKQAITKVYIVGKTKKRKFIPPMENFRSHAKNHLEGILISFKNKNKVVTKNKNRTKTKTKGVFNEKIQLTPRGQLHKETIYGHAKKVIVTKEKVSSKFTHEKILQVTKPAYREALLKRLASFKNDPKKAFSGKNALSKNPLYFDITSGKKVPDTVKLSYFENSYVIRKEVNSDNFKNEKSLQKVLDVGIRRILEKRLADYNGNAKEAFSNLEKNPIWKDKEKGVCIKKVRIEALKNAEPLHVKKDHLGKIILDDENKSTPVDFISTGNNHHVAIYEDKDGKLHDKVVSFYEVVSRVNLGLPIIDKSFNSHLDWKFLFSMKQNEMFVFPSEDFNPKEIDIGNPKNNELISKYLFRVQKFSKVTYGNSAVRDYVFRHHLETELIDKKELKGITYYQLKSIGMLEKLVKVRINHIGKIVHIGEY

SEQ ID NO: 60 - protein, 1116 aa, Clostridium spiroforme
MVEFLLKEMKIMGRLVLGLDIGITSVGYGVIDIDKNEFVDYGVRLFKEGTAINNEERRSKRGARRLKRRKTNRIADMKKLLERNGLIDEQYTALNNPYEIRKKGLKNKLSNYELATAILHITKNRGTCLESNADETQDEESTKNILSKNALELKDKYICEIQLARLEESGKIRGINNNFKTEDYLKELSKILENQDLEKETIDKIKEIVARRRRYDQGPGSEKSPTPYGSYRMENGELVHVNLIDMMRGKCSVFPDQLRAPQQSYSAELFNLLNDLNNLKINGEKLSSTEKQKIIDFVNEKGGITVKQLLKLIDVGITEISGFRIDKNEKPLITEFKGYKKVLKVFKNYNQESLLNDKSIVDTIMDINTKIKSIDERSDQLKQVLPSLDTSIINDLASIKGVSGYHSLSLKALNLINNEMLKTEMNQMQVLHQLDIFDKNRVSLKGQRQIYADDNAILSPVAKRAHRETFKVINKLRSIYGEFDSIVIETTRDKNTQDQKKRIKNNQKNYEERNTEVNNFLKEAGYNPENINAKTKMKIRLYIEQDAKSAYTLQDINLKELIEDEKAYEIDHIIPISISLDDSFNNKVLTTHDENQEKGNLTPISAFLKGKFHNGNLNTYKVFIQNNKNLNRKKKEYLLCEDDITRYEVVQNFINRNLVDTSYACRTVMNTLVHYFKDNEINTKVHTIKGQATSTFRKRIGLIKDREEDYFHHAIDALIVASLKKMNLINSYLMKVDFNEMYDEETGEIFNVLPDNSYLDEKYISFVSNLKNIYEESNKYIRGVMIKEKMTYPLIKVSHKIDTKPNRKISDDTIYSTRNVDNQDMLVERIKNIYDPKENAANTLINDIINDNTDKYIMYHKDPQTFDKIKAIVLNHFNEFKTDKNCYIVTKEGLYKLKGTSPLALYYEEFGPITKYAKKNNGPTIHSMKFYSEKLGNHLSITHKYSTVNKKVITKQISPYRTDFYQSPEGKYKFVTVRYKDVAYNAKKDKYIIDHSWYREQKKLKKIADEWIFVCSVHRDELIGIMKADGQKRIFDSSTESDGETLYHDAKTYEILKFTATNNDITGRFEVKPIYCYCKKQLMVSIGTCRKIQKFATDVLGNLYIVKDNVLKLEFK

SEQ ID NO: 61 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 62 - protein, 1129 aa, Streptococcus infantarius
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 63 - protein, 1065 aa, Clostridium perfringens
MNKDINYALGLDIGITSVGWAVINLDLNRIEDLGVRIFNAAENLKDGSSLALPRRLARGRRRLLRRKAYRVERVRKLILKNNILTKEELEGLFKNKEVIDVWEARVKGLDYKLSREEWAKILINFCKRRGFKSNRKNEAKDKEAGQILSSISYNIEKMKETNSRTIGEYIYNEVKNSEDSYAPLRNKFGEYKMCVSRDVIREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEEELFSTLTYSIDKDISKTENTKFVSLKGYHEIKRAIEKGVSKKAWQDIENNRNLLNDIAYVLTLGKTDDEIEKQLRLRNVPEELFESLLDMSFNKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTVVEVLKYRLWEQQRGECAYTQSQIPLERLFSPGYCEIDHIIPFSRSFDDSLSNKILVLGSENQRKGNRTPYEYFGEDSERWNSFEIWVKGSYLNYKKKANLLKKKFSEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKSPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEGMVRIDIYEKEGKYFVVPVYRYQLAKGIVPKRAAIAKKDELKWPIMDQTYNFKFSIYKNDLIEVKYDKKGVYFGYYDGFDRNSASLTIEKHDNSERYRSIGLKVGVLEINKYEVDVLGNYHKVKLGGN

SEQ ID NO: 64 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 65 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 66 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 67 - protein, 166 aa, Unknown
  uncultured Termite group 1 bacterium phylotype Rs-D17
MNKVQEIEYKKIREKLADREYRIGLDLGVGSIGYVVVSLKECNDLSYLPEDIILSGSRIFKSSIGAVERREFRLQRNSHRHHRERMRFLWQLLAEKQLALQSSKDLEKKENSADCETSQKRFPINILKEDPYILRYKALEEKLSLFQLGYVLYHIANHSNTAYENT

SEQ ID NO: 68 - protein, 1032 aa, Unknown
  uncultured Termite group 1 bacterium phylotype Rs-D17
MLYHIANHRGTDSVRSFLEYDDDKIKENTLTAKIAKETKKVIDAKKYRTFGEYLYKGKIEKFQQNIRKKVSNRKTPANKNKEFAVTRDVIIKETEKILASQKQYYTYILTDEYIKKIKDAISYQTEKLIPESGYCPYFKDEKRLPRSHKLNEYRRMYEALNNAKYFDPVLDENTGEILSYQEKEFSREEKKILFDEVLLKGMELTESGAKKLLYHLPDGCEVQLQGRDKTTQKIKGYALVDLEASPFWLRLSQQQQDEFLYDWNSLPLEKLKPKLTNYYSLTESEVDETFQEIKLPSNYASVGKKAMEILLTYIKDGCSYTEALEKAVSEGKLKVDKQTMIYDSLPYYGKILKESTQKLIGKAFSKQFADRNYKEPDTNKNEREFGKIANPVVHQTLNELRKLINEIITVFGKKPLEIGLETTRELKKSKKNREYLSKQQNKNEYARNRIYKEYIEPHLSQIKSRQENPSKYISKFELLEEQNFICPFCSEKITPDDIINSKVDVEHIFPIEESEDITKNNLVIAHNECNADKGKKSPFDAFGDKTSGKYRWNCILHNAQKNLPHKVWRFYQGSLEKFLENKPMSRRFGTDNSYISKIAARYLACLFNDPYHSEIFCIKSSLIAQLRIAWDLNSIMVPLVKNILSEKELEEFKISKNKKIRIDNRHHALDAIVIAYANRGYHNFLNRIHAKEYKINYREKSWLSKILLPPLNRDLEDFKISVKDSIEKANVSIKHDHNTNGSLVKATAYKVYYSGAGEYIITTSKNVEEISFKEKEDPKDTLYRALCKFECRDIDIKDEKLIKKLKYNSTLYKKVQNNLSKAKQELEQDNKKTEEEGKKSQKITEVRIYKKACSLVKGQYIQCGSRLKDKFFAVKEPTEIKTGLGYDTGDNLFLDLYYDKTGKLCGEIIRKVNFNRNKPNYQKEGYTLFERIYQSDILEVDTSEDRISLKNKTGSAPSDRTFIKVNTFTEVNAYFDGKRDKIQIFFGNLLKSSFKNDSFFISSMQKYNVRKVILTSLGIIKYRSQILKNKEV

SEQ ID NO: 69 - protein, 1032 aa, Unknown
  uncultured Termite group 1 bacterium phylotype Rs-D17
MKKRILGLDIGIASVGWALVEFDDEFQDNKKKGTIIKSGVRIFTRAETPKERESLAKPRREARSQRRRIRRRVERLNSIRELFVKNGVVEEWSVSKKNPNNIYITLNQIKTPWQLRMESLDRKLTNEQFAVVLTHLAKHRGYKSLRKDDKAGKVLEAISQNKKRLNDSDYRTLGEMFCKNESYKEHKRNKGGEYINSVARELIEEEVEKIFVKQREKGNNFADVNTEREYLKIAFSQKPAGSISKMVGFCTFENGEKRAPRDSYSAELFKVLCTINNTTFTDMKTGEIRSFSKEEIGKTLETVKNVKDVKYAKIRKDLGLEDSVKFSGVDYRENAKSKGEGEIFVSMKTYHEIKSKIEKLSKEKWDNLKGNTELLDSIVNIIANLKDDESIKKEFQKLKIDEDIIDVLLNFEFKKFINLSFKALRKIIPFQFQGQKYITASTSAGYSLKQEGIKNKLVPPAKENINVAVVARAFAQTRKVINAVIRKYGQFDQINIELATELKNSKFDRSKIEEGQKKFQSQKDKIFKEVQELRGGMTPSSSLLLKYRLWREQDERCVYSGRKISFEDLLDTGFLDIDHIIPYSKSMDDSFNNKVLCLAEENRNKKNDIPFNYYQRIDRDWNLLISIITSMKNMKIAKKSRLLKQELSDIEGFIERNINDTRYATRYIKDFLENNLEFKENEFIKVKVQARSGGLTSVLSYNWGMSKDREESYFHHAKDAIIVACSTQGMVQYISKISQQYENDKDKMKKIKDKTENCIPKPWDSFRADVEESIEGIFVSFAPRHKVTGSAHKETIYSKKHLEKERYVTVKKSLDKIKLSDLENIPCNENCGIIRVLKERLEKFKNDSLKAFADPVHMPTKCPNKKGPVIRSVKIKESNKTGIEVRKGLAERGEMVRVDVFIKDKKYYLVPIYVSDFKNKDLPNKAIAALKLENEWIMIDKTYSFKFSLFKDDLIKIKKKKEEIFGYFGGVHRSTGTIKIKSRHKPKEIDEGIGSRCLLDFRKFQVDVLGNYTEVKHEKRMPAYITRKDKKH

SEQ ID NO: 70 - protein, 1361 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 71 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 72 - protein, 1341 aa, Ruminococcus lactaris
MGKGYYVGLDMGTGSVGWAVTDESYQILRRHGKAMWGVRLFESAKTAEERRMFRTGRRRLDRRGWRIEILQEIFAEEISRVDPGFFLRMKESKYYPEDKRDIQGNCPELPYTLFVDKTFTDKDFHKKYPTIYHLRKMLMETEDTPDMRLVYLALHHMMKHRGHFLLSGDISQVTEFKNTFNQFIENIRNEEMDFEIELDESAVQMIEETLKDKNLTRSAKKSKLVKGLNAKNVRDKAFLTLLSGGTVKLSDLFGMEELNEGERPKISFADNGYEEYAAVVEMELGELYYIVESAKAVYDWAILSDILGGSTSVSDAKVRAYEKHKADLKYLKAVVKEYFPKEVYNAVFVESSDKLNNYPAYIGMTKKNGKKVSLEGKRCSREEFMDFLKKNIVVKLPDEEAKMYLQSELEKDSFLPKQVNKDNGVIPYQVHKYELKKILDNLGDKIPFLKENAEKIEKLFSFRIPYYVGPLRTGNGENSKFAWAERKSTEKIYPWNFENVIDVEQSAENFIRRMTNKCTYLIGEDVLPKDSLLYSKFMVLNELNNLRLDGQKISVELKQKIYRDVFCRSRKVTQKKLKSYLIREGIAGKNVELTGIDGDFKGSLTAYHDFKEKLIDVELTQKEKEEIILNIVLFGDDKKLLKQRLKKKFPQLTEKQINTVTALSYKGWGRLSKKLLEEVTVPAPETGEVWNIITALWETNDNFMQLLSKEYQFSDRIEEFNEEKADPEVSYQTIEDLYVSPAVKRQIWQTLQIIQEIEKVMGEKPKRVFVEMAREKQENKRTESRKKTLSDLYTKCKKEEPEWIEALCTSLEKHEEHQLRSDKLYLYYTQKGRCMYSGEPIDLEDLWDNTKYDIDHIYPQSKTMDDSLKNRVLVKKEYNAKKSDTYPIAADIQKKMMPFWKSLLTGGFIPKEKYDRLVRNNPLDANELAGFIERQIVETRQSTKAVAEILKKILPDTEIVYVKAKTVSKFRQDFDFIKVRDMNDLHHAKDAYLNIVVGNVYFVKFTKNAAWFVKENPGRTYNLEKMFIWDVARDGEIAWKAGKSGSIVQVRAMMEKNHILVTRRSYEVKGGLFDQQILKKGKGQVPVKESDERLRDIGKYGGYNKAAGVYFMLVSSKDKKGKEQRTIEFVPIYLKDRVEKDMESARNYLMEERGLREPKILIKKIKIDTLFKVDGFYMWLSGRTSNQLIFKGANQLILSKEDMKTLKKVVKYIQRQKEDKNVKISMRDGITEEELLKLYETFLDKIRHSIYGARLSSQEKTLVNGKEKFIDLSVEAKCQVLYEILHLFQCQSGAANLKMIGGPASAGILVMNNNISKCKNISIVNQSPTGIYEKEIDLLRV

SEQ ID NO: 73 - protein, 1003 aa, Gluconacetobacter diazotrophicus
MIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALIPTPVGPDSYVIA

SEQ ID NO: 74 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 75 - protein, 1504 aa, Bacteroides dorei
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNYPNLITDDKKVPYDWTIYYLRKKGLTSKISKEELAWILLNFNQKRGYYQLRGEEEEENKDKLVEFYALKVVAVEDSGEKKGKDIWYNVHLENGWVYRRTSNMSLDWVGKTKEFIVTTDLEKDGTPKKDKEGNVKRSFRAPKEDDWSLVKKKTEADIDQTHKTVGAYIYDTLLGNPSQKIRGRLVRTIERKYYKEELKLILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIINLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSYYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNKSATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 76 - protein, 1426 aa, Capnocytophaga sputigena
MKNILGLDLGITSISFAHIVEDENKEKSEIKELGVRIVSLTTDEQSDFEKGKSITTNANRTLKHGARLNLDRYQQRRKYLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQREFDLVWNFQKQFYPDILTDSFYKELQGKGKDATSKAFSKRYHFDTAENKGSKESVRLQAYQWRAEAISKQLSKEEVAYVLTEINNNLNNASGYLGAISDRSKELYFNRQTVGQYLYAQLQENRHNSLKNKVFYRQDYLDEFERIWETQASFHKELTDELKKQIRDVVIFYQRKLKSQKGLISFCEFESKEIEIEKDGKTITKTIGARVVPKSSPLFQEFKIWQILNNVTCKRKGIRKKKSSAKSTELDLFNEPSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIKEKVKDIFQALGICTKILYFDPLLPVKEFEKQDSYQLWHLLYSYESDDSTSGNETLYRILEKKYAFKREHARILANVALQDDYGSLSTKAIRKIYPNIKENQYSKACELAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKKFGIKNPTKSDIIRYRLYQELEHNGYKELYTNAPIARDMLFSKNIEIEHIVPKARVFDDSFSNKTLTFHRINSNKGEYTAFDYITSLNSEEELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNVNKPAGTDKQQITLTPRGQLHKETIYGKYQYYVNKEEKVGVKFDERTITKVSNPLYREALLKRLQANDNDPKKAFTGKNALSKNPIYLDETKTKTLPEKVNLTYLEEDFSIRKDISPDNFKDLKSIEKVIDQGVKRILIKRLQDYDNDPKKAFVDLEKNPIWLNKEKGIAIKRVTISGVSNAQPLHIGKDHLGKTTLNKEGNEIPVDYVSTGNNHHVAIYRDKEGNLQEQIVSFFEAVVRTQQGLPIIDKTYKQEEGWQFLFTMKQNEMFVFPNATTGFNPAEIDLLDPKNKKLISPNLFRVQKIATKDYFFRHHLETNVETDNVLKNTTWKREGLSGLKDIVKVRINHLGDIVSIGEY

SEQ ID NO: 77 - protein, 1443 aa, Parabacteroides johnsonii
MIKLLYLEKLKQYTMKKILGLDLGTSSIGWALVNEAENSDEVSSIIKLGVRVNPLTVDEMQNFEKGKSITTNADRTLKRSMRRNLQRYKLRRDALIELLKKVGFITDKTILSEQGNRTTFETYRLRAKAAEEEISLKELARVLLMINKKRGYKSSRKAKGEEEGALIDGMEIAKKLYDEDLTPGQLCLQLLESGKKFFPDFYRSDLQEEFNKIWDFQKQFNLFSFCDVAKEEVKGKNKSQTWAILAKYFVETKKVNVWNEHEAQTENREEVYKLVGLKRTVKGEELKKENYRWRVQALTEQLDLEKIAVVLQEINGQISASSGYLGAISDRSKVLYFNRQTVGQYQMAELNKNPNMSLRNMVFYRQDYLDEFNVIWEKQAEFHKELTPELKKEIRDIIIFYQRRLKSQKGLISFCEFENREVVVEKEGKKQTKIIGCKVIPRSHPLFQEFKIWQTLNNIEVFVGEKKGKRKKSNVSSDLFGDTEDALITEGRRFLYQEEKKILAKELSIKKGLTKAEILRLLFENPQELDINFKQIDGNQTGFALFSAYSNMIEKYGYEPLDFKKPAEDLISQLKTVFTDLGWNTDLLFIDLDKENKEWEKQPYFRLWHLLYSFEGDNTPTGNGKLIEKIMQLCGIEKEYAIELANVSLQDDYGSLSAKAIKKILLYLKEGNQYDMACEYAGYRHSKSSLTKEEIENKVLKDKLEILPKNSLRNPVVEKILNQMVNVINTVMEVYGRPDEIRVELARELKKSAKEREELTKAVAKNTREHEEIRKVLQSEFGMINVSRNDIIRYKLYEELKDNGYKTLYSNQYIPREKLFSKEIDIEHIIPQSRLFDDSLSNKTLEYKSINIEKGNKTAYDFVKEKYGEEGLQQYLNRCENLCKDKKAKLRKLKMELNEIPDGFIDRDLRNTQYIAKKALSMLTEICRRVVATTGSITDKLREDWQLVDVMKELNLPKYEALGLVEVYEDKDGRKIKRIKDWTKRNDHRHHAMDALTVAFTKDVFIQYFNNKNAAWESDSKEHTNIVGIKTRYFESGKAVPPIPLGQFRVEAKCHLENLLVSIKAKNKVVTTNVNCIKKKGGTYKNTQQTPRGQLHLETIYGSHNQYVTKIEKVNASFDAVKIATVSKQDYRNALLKRLEVFGNDPKKAFTGKNSLEKNPIYLDRAQTIQVPDKVQTVELETAYTIRKPVDPTLNVDKVVDKKIRLILEQRLKEYGGDAKKAFVNLDENPIWLNEEKGISIKRVTIRGISKAQALHDKKDKDGNFILDETGKRIPVDFVNTGNNHHVAIYRKPVLDKKGQVIFDDEGNPMYELDEDVVPFFEAVTRANLGIPIIDKDYKKSEGWQFLFSMKQNEYFVFPNEKTGFNPKEVDLLDPDNYAMISPNLFRVQKIGLNDYTFRHHLETTIQNDLKFITWIRCGKSGIKDIVKVRINHIGQIVSVGEY

SEQ ID NO: 78 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 79 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 80 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 81 - protein, 1131 aa, Acidovorax ebreus
MAQHVFGLDIGIASVGWAILGEQRIIDLGVRCFDKAETAKEGDPLNLTRRQARLLRRRLYRRAWRLTQLSRLLKRKGLIADAKLFAKAPSYGDSAWELRRQGLDRLLTPLEWARVIYHQCKHRGFHWTSKAEEAKADSDAEGGRVKQGLAHTKALMQAKNYRSAAEMVLAEFPDAQRNKRGQYDKALSRVLLGEELALLFATQRRLGNPHASDFFEKLILGDGDRKSGLFWQQKPALSGADLLKMLGKCTFEKGEYRAPKASFSVERHVWLTRLNNLRIVVDGRSRPLNEAERQAALLLPYQTETSKYKTLKNAFIKAGLWGDGVRFGGLAYPSQAQIDAEKTKDPEDQFLVKLPAWHELRKAFKAAGHEALWQQISTPALDGDPTLLDQIATVLSVYKDGAEVVQQLRQLALPEPAASIAVLEKISFDKFSSLSLKALRRIVPLMQSGLRYDEAVAQIPEYGHHSQRIEPGAAKHLYLPPFYEAQRKYAGKGDHIGSMQFRDDADIPRNPVVLRALNQARKVVNALIREYGSPIAVNIEMARDLSRPLDERNKVKRAQEEFRDRNDRARSEFERDFGYKPKAAAFEKWMLYREQLGQCAYSQQPLDIQRVLDDHNYAQVDHALPYSRSYDDSKNNKVLVLTHENQNKGNRTAFEYLTSFPDGEDGERWRTFVAWVQGNKAYRMAKRNRLLRKNYGVDESKGFIDRNLNDTRYICKFFKNYVEEHLQLAARADGDTARRCVVVNGQLTAFLRARWGLTKVRGDSDRHHALDAAVVAACTHGMVKALADYSRRKEISFLQEGFPDPETGEILNPAAFDRARQHFPEPWTHFAHELKARLFTDDLAALREDMQRLGSYTTEDLGRLRTLFVSRAPQRRSGGAVHKETIYAQPESLKQQGGVIEKILLTSLKLQDFDKLLNPESNDHFVEPHRNERLYAAIRQRLEQFGGRADKAFGPDNLFHKPDKNNQPTGPVVRSIKLVRGKQTGIPIRGGLAKNDSMLRVDIFTKAGKFHLVPVYVHHRVTGLPNRAIVAFKDEDEWTLIDESFAFLFSVYPNDYVKVTLKKEQQSGYYSGADRSTGAMNLWAHDRAASVGKDGLIRGIGVKTALSVEKFNVDVLGRIYLAPPETRSGLA

SEQ ID NO: 82 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWGEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 83 - protein, 1509 aa, Bacteroides coprophilus
MKKTLGLDLGTNSIGWAVINSNIDSEGKEKLVGISSCGSRIIPMDATTLGDFGKGNTKSPVAERTRLRGIRRLLERSLLRRERLHRVLSVMGFLPEHYASQLDRYGKFLPETEPKLAWYKDDSGRYQFLFQKSFHEMLEDFRQHQPELVAGEKKIPYDWTIYYLRKKALSQEITKEELAWILLNFNQKRGYYQLRGEEEQEENNKSVEYHALKVVSVEDSGERKGKDIWYNVTLENGWVYRRASNIPLDWTGKVKEFVVTTELDDAGNPKKDKEGNVKRSFRAPKEDDWGLLKTRTQAQIDESGKTVGTYIYESLLCMPNQKIRGKLVRTIERKYYKDELRQILVKQSEFHAALQDHNLLLSCIEELYPNNEAHRRLLSASSFIYFLIEDILFYQRPLKSQKGLIDNCPYESHIYKDKKDGSLHHVPLKCVSKSHPLFQEFRLWQFLSNLRIYQRERMMDGSLKLDVDVTREFLPSEEDYVKLFDWLNERKEISQKFLLAYKPFGLKKNEQANYRWNYVEDKSYPCNETRAEIKSRLSKAGVPEEFLTEEKEEALWHILYSISDKKELTKALGTFAAKNCLNESFVEVFAKIPPFESNYAAYSLKAIRKLLALMRMGKYWNEQAIDRQTRDRIEKILTGEYDETIRSRVREKAMLLTDISSFRGLPLWLACYIVYDRHSESKELVKWETPADIDHFLSKFKQNSLRNPIVEQVITESLRTVRDIWKQEGKIDEIHVELGREMKNPAKERARITAQVQENENTNLRIKALLAEFMNPEFEIENVHPYSPGQQEILRIYEDGVLSGIAEKDLPDDITAILKKFRENDVKKRPTTSEVLRYKLWLEQRYRSPYTGRVIPLGKLFTPAYEIEHVIPQSRYFDDSISNKVICESAVNKLKDNCLGYEFIKKHSGEMVELGNGETVPVFSVEEYERFVKESYFGNSKKMKKLLLEDIPDSFIERQLNDSRYISRVVTSLLSNLVCEEGEQDGLSKNVIVCTGGITDRLKKDWGVQEVWNRIILPRFLRLNEITGRTDFTSTSVNGHLLPALPLYLQKGFNKKRIDHRHHAMDAIVIACANRNIVNYLNNSSARKNSEISRYDLQRLLCEKVKTDANGNYKWILRKPWETFTQDVYAALTNIVVSFKQNLRVINRTTNYYQHYNEAGEKRMIPQTKGDRWAIRKPMHKDTVYGEVNLRKEKTLPLRDVVKNPSIVVDKSLKNKLYELLKSQYDLKAIAKYFETHQDVWADVNLKKIKVYYFTKETNERFFATRKSLDPSFDQKKIEEEVTDTGVQKILLHHLQQNNNDPDMAFSPDGIDRMNQNMTILNDGKWHQPIYKVRTYEKADKFAVGESGNKAKKFVEAAKGTNLFFAVYESVQEDEAIGKQVCKRTFATIPLNEVIKRKKQGLPAAPEDLNGNLPKFVLSPNDLVYLPTEEERNSSRIIQPLDRERIYKMVSSSGSQCFFIKVFVANSIWDKNEYSSLNKMERAITNEMIKEICVPIKIDRLGNVSLIQI

SEQ ID NO: 84 - protein, 1219 aa, Bacteroides cellulosilyticus
MKEEVRGKNRSQTWAILAKFFVWSEKESVWNEKEARTEERVKEYKLVGLKRDTKGNELKLENYRWRVQALSEQLNPEIVAIVLQEINGQISASSGYLGAISDRSKQLYFNRQTVGQYLMSELEKDPNVSLRNRVFYRQDYLDEFDRIWEKQAEFHEELTVELKKEIRDIIIFYQRRLKSQKGLISFCEFEKREVVVEEDGRKKNKTVGCRVIPRSHPLFQEFKIWQTLNDIEVFAWDKQSKRKKADKSSILFDNSEDALLVEGKRFLYQEEKELLAKELFVKESMKKAEVLKLLFENYQELDLNFKQIDGNHTGFALFSAYSKMIEKYGYEPVDFKRSADEIIEKLETIFTNLGWNTELLSIDLSKEDKELERQSYFRLWHLLYSFEGDNTPTGNGKLLEKIMQLCDVEKEYAVELANVSFQEDYGSLSAKAIKKILPYLKEGNQYDVACDYAGYRHSRSSLTKDEIENKILKDKLEILPKNSLRNPVVEKILNQMVNLINTLIDTYGKPDEIRVELARELKKNAKEREELTKSIARNTREHDEIRQLLRTEFGMMNVSRNDIIRYKLYEELKDNGYKTLYSNEYIPREKIFSKEIDIEHVIPQARLFDDSLSNKTLEYRAINIEKGNKTAYDFVKEKYGNDGLEKFLNRCETLFKDKRTKLRKLKMEEKDIPEGFIDRDLRNTQYISKKAFAMLNEISRRVVATTGSITDKLREDWQLVDLMKELNLPKYEKLGMVEMFEDKDGRKIKKITDWTKRNDHRHHAVDALTVAFTKDVFIQFYNNKNAAWMPASKEHANITGIKARYFENGKALAPMPLAQFRAEAKRHLENLLVSIKAKNKVITSNVNRTKNKNGENRKLQQTPRGQLHLETVYGSHRQYATKIEKVNAAFDVTKIATVSKLAYRNALLKRLEAFGNDPKKAFTGKNTLEKNPLYLDENQTEMVPEKVQTVEFETVYTIRKPIDPNLSIDKVVDVKIRSVLEKRLKEYGGDAKKAFVNLDENPIWLNEAKGISIKRVSIRGISNAQSLHEKKDKDGNLILGKEGRKIPVDFVNTGNNHHVAIYKKPVLDKVGQVVLDEEGNPKYELDEVVVSFFDAVTRANLGQPIIDKDYRRSEGWQFLFSMKQNEYFVFPNDKTGFNPKEVDLLNPENYALISPNLFRVQKFAYKNYVFRHHLETTIKDTSSTLKGITWTDFRSSKGLDKIVKVRVDHIGQIVSIGEY

SEQ ID NO: 85 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 86 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 87 - protein, 686 aa, Coprococcus comes
MKKQDSPKNNMGYTAYNLNVLGYEEFAKRVELLFKDTDAVKRLNDSHMQMAEGFDLNALPGSPALRRGVSQAIKVLDDIVSVAGKAPDRIYLKVTRTASNSRKGKRTAKRSDKIKQALKALDADAAADLGAAKLLRELGMFDEKEINERIYLYFHQAGKCLYTGKPIDITRIASNDYYVDHVVPLAYRKDESLDNKVLVYAEASRYKSETLLVSPAVQRKMLPFWRMLRNAGLMSERKLNALIRTEISEGMLKSIIGRQFTENSWEAKLFTAAIAAKYPGTVVIPVKAGVIGAVRSRIGIPKSLKANQFYHAHDALLAAEVGRYMELAKPAFVHNRVKYEQYMRKIKLVNEENKKAPKSQLDFFAGGFFFDRVDKDTGEVYWNKDEEVERIYRACGWKNLRVTYAAFEDGGAFWKQTIYSPREKSKLIATKSDRPAEIYGGYSSQTFANFFVYEVMKKKVKQLRFGAVPAAIASKSDPDTYNAMLEMYARGLAKTAKEKFVRIVRARVLKNTMIELYGERFRIAGEKQVYPVRQMPLAIDEVYLLKGVETIAAAGNAGASAKIDFEKAAESLVGFWDLLLEKLPVNYPKLTVQLKLGLLKHPKDILAATSESEFPAIVYKIAEAEIQVMEQASGLRNMSDTKILGGNTFGGSLVFTFNKVLNDPKSKACFIDTTPAGLYEVKTKIW

SEQ ID NO: 88 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 89 - protein, 1361 aa, Anaerococcus tetradius
MGNYYLGLDIGTNSVGWAVTDENYNIERFKKKNMWGIRLFDEAKTAESRRIHRQARRMRQRKIQRLNLLMELFDVEISKVDESFFIRKKESDLHYEDKSQDSRYALFNDKEFNDKDYHNKYPTIFHLIMDLIENDEKKDIRLLYLACHYLIKNRGHFIFEGQKFDVNSSLNNNINKLKSHLDQFYNICLDFDNDKLIEILVNQNLNISEKSKKIKELLRKTNLEVGIANLIAGGSIKLSNMFDDDELKNLDYNSLSFKNSNFDEGRELFEEVLEDRFELVEILKDIHDASVLETMLSSASISPDGGKYISSSMINSYNKHKRDLKLLKKIIKKYKKSEYDNIFRDENIKNNYLSYTRTGINKNKKVQAEDNTDSDGFYKYIVKILKDIKENDSDEDIKYILSEIDKKNFVPKQRTKENSVIPYQLREIELRKIIDNQSKYHKFLNEVDEKGISVKEKIISLLTFRIPYYIGPLNPSYNEEKNFTTSWVKRLAKGKVTPWNFEDMVDIDASREAFIENKLNKCSFLLDETVLPKDSLLYQEYMVLNELNNLKINGQSINTDLKKSIYEELFKKYKKVTRKRLISYIKEKENMSGDIVITGIDGDFKQGLKSYIAFKDIIGEKIDDDIYRKEVEKIIRDISLYGDDKSFIQKKIKNENKLDLSDDQISKIAKLKFKDWGRFSKKLLVGIKASDKNTGEIDNIIGFMRNYNYNIMQLMANVFTFKDEIEKLNSKYYTDEKINIDYLDDLYLSSPAKRMLWQSFQIVDEIKNIKNSDPKKIFIEMARSKEDKPTRKMSRKSRLEKLYTDSKKQFIKLFGPDEYDKLNNEIKNKSESDFRWDNLYLYYTQFGRCMYSLDPIDLEELSNKNLYDQDHIYPKSKIYDDSIENRVLVKKQLNLDKSNEYPIPDRVLNKDKNKLLAFWKMLNEKELIGDKKYARLIRKSPFTDEELGDFIARQLVETRQATKETANMLKRLCPDSKIVYVKAKNVSDFRRKFDILKCRSINDLHHAHDAYLNIVVGNVFDTKFTSNPLNFIKNNSKNRSYNLEKIYDYDVIRNEKIAWLAERKEENQDGSIATVLKNLSKNDIRVTRRTYIKCEDLFDENIVRKGNGKFPIKENNNKSDTNKYGGYSGIKNAYFVLLEDEKHNRILEAIPSFIYKKEKNGEKGSVINYLQNILGIKSAKILRDKIKIGSLLKIDKFPYNLAGKSGNGILISGGVQLILDKNTSKYIKKIENYKYKLDENKDYQINIFDKLSKEENIKLFDLFVDKFENSIYKNRVNIKLKEIKLARPKFEHLSIEEQIKTLTQMLILFGRENNAVNLEYIGLPKNTGKTKINKKINNKDIKIINQSITGLYETEEDLANI

SEQ ID NO: 90 - protein, 1377 aa, Lactobacillus brevis
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 91 - protein, 1239 aa, Lactobacillus buchneri
MTEKRKFDIREVYLAIHHIVKYRGNFLNSATVDSFKTSNIDFTSQFDRLNELYRQVILEEPFQINMNQVDKMTNKLLDNDALKLDTQKQVAKLLPVIYNDKPVDKQYTRLATEFSKAILGYKTKLDVILNLDTQNAKDWAIRLDDEDIDDKLPALVENLDESRQEIVTIIRDLYAQITLNAIVPKGKSLSESMVDKYNDHKDHLDLLMGLIHELGDDSAKGIKLREAYTQYVGKSGDKTLNQDDFYAAIKKNLDEDSKRSPKIQRLIEQASFMPKQRTSANGVIPHQLHQLELDRIIENQGRYYPFLKEPNSNTHKPNGGKYKLDELVAFRIPYYVGPLITKQDQEKTSGADFAWMIRKPGQGGEITPWNFDQEVDRMASANTFIRRMTTKDSYLVAEDVLPDSSLIYEKFKVLNELNMLKVNDRRLSISQKQDLFNNLFKKQKTIRTKKLQTYIRTKWELPSVMISGLSDPDKFNSSLATYIDFRDVFGEKVDDPNRQADYEKIIEWSTVFEDRKIYQAKLNQLDWLTESQSKALLTKHYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSPQDRPQRTFSRQRQLQSTYLNVAKALMKSNLNQELKSVIDSQQTLTDKLYLYFTQLGQDMYTGKEINFDELVNYQIDHILPQAFIKDDSLDNRVLVSAPINNAKSDNVPVKKFGAKMGYFWKQLAENHLISKRKLNNLTTDPDKIGKFTAQGFIHRQLVETSQVIRLVANILGNEYGHDGTTIIEVTAKMNHQMRKDFDLIKIRDVNDYHHAMDAYLTAYVGDYLYLRYPKLRSYFVYGDFKKLKDQSLKIRNFNFLHDLTNDEAGDKIVDQETGEIIWDKHESVKQLKKVYHYKFMLVSQEVYTRQDALFNQTIYPASDADKRKLIPIKNNKPVDVYGGYSGNVDAYMAIVRIHGKKEDKYKVVGVPMRAVADLKKAESKGRDNYLNAVHEVLKPQFTKKKKDRKTGEITEMMDDFDVLLGKVYYRQLIVDGNKKFMLGSSTYQYNAKQLVLSDKAMQVLSKDDKLKNQDENQNLIDVYDEILEKVDQYFELYDINKFRQKLHDGRKKFIELPVDNDFNGKKLISYGKRATIISILNGLHANATMSNLKYLGISSPFGMLQVPNGIILSPASRICYQSPTGLFERKVKLSDL

SEQ ID NO: 92 - protein, 1381 aa, Lactobacillus fermentum
MDYVKEYHIGLDIGTSSIGWAVTDSQFKLMRIKGKTAIGVRLFEEGKTAAERRTFRTTRRRLKRRKWRLHYLDKIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNAIVPNGMSISESMMDRYWTHERQLAEVKEYLATQPASARKEFDQVYNKYIGQVPKEKGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKAGDVASLVMAKTRGVNKPSVEGLSDPKKFNSNLATYLDLKSIMGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 93 - protein, 1306 aa, Sphingobacterium spiritivorum
MKHILGLDLGTNSIGWALIKQNFENKQGEILGMGSRIIPMGAELSKFEQGQAQTKNANRRIARGTRKLNKRYKQRRNKLIYILQGLGMLPDQIKLVNQFSDPNKLDKISILPISKNQQQLTAFDLLELRVKALTEKIELEELGKVIYKYNQLRGYSGGNSEPEKEENNEDESEENEKTNDSFVVFSKVLSLGLPEEITFKGKKLSKRKIAIETEDGIIEAETFLDSLKENDSLELHVNIRRAKSGDTITIKLPSKTSWRKKMENIEKQLADKSKELGREYFISELLFDILKENKWAKIRNNVILRSRYESEFDAVWSEQSKYYPILNHLETDRLQKILEFIFPGQKESQEKLRQTGLKEGLKYVIKNQVVFYQRELKDQSDLISNCRYEPTEKVVAKSHPVFQEYKIWEQINKLVINTKIENGVNRKGEIRYKYIDKPIPVALKEWLYEELQSKKEVSFNPILTKLKKEFKLRENVDFLNGMNAKDKLKGNETKVILQKALGELWNIFGLDDSERQVELWEILYNGKGNEYDLTSERTSNILAFIEKYSPDLENKNDVAIKISKIKFSRNYSNLSLKAIDNILPLVRAGKFFDQNFSEALSHKIVKLLNENVEDPFEKSAQEFLDKNQDVLSDGGIVNAIATILVYDKHTAKEYSGDELIKEFTQISRLKQGELRNPLAEQIINEALVIVRDIWRKYGFKPDEIRVELARELKNNAVERGKMYSANLKSQKHNAEIRNKLIELKQEISIANIEKYKLWVSQENLQEVYLKNYNDPSKSEIEKLKLWESQGHISPYTGQPISLSELFNRERYDVDHIIPQSRYFDDSLSNKVICEKSINNEKGNRTSMEYFEVGSVNYRIFTKDQFIDHANKYFSGKKRKNLLATSIPEDPIQRQIKDTQYISIRIREELNKIVGNENVKTTTGGITDYLRNHWGLTDKFKVLLKERYEAVLPKIAQLEYDNYKKETEKKFTEYKNADVEFNEPILDEEIFIEKFRSEFIRKKNNKLIIKGWSKRIDHRHHAMDALVIACTQPAHIKRLNDLNQVLKEWLDKNKEKFFPGFSGTKTELLDEVLNLEEEKRREIFNQLEKFRAIEMPWKGFPEEAEQKLKEVIVSHKPKDKLLLQYDIQGNKQIKLRGQLHEGTLYGLSNGKEIYRIPINKLAGKQFATEKTIEKIVNPFLKNVIEEHLKSFGKKEEAFSAEGILDLNKKLAERKDEQQNPKPHPPISTIKIYYKDPSKSKKKKTDDEDDISLQKLNRKKSFNDSLYVKTGDNYLFAVMEKEVFNKKLNKDKTERHYDLKLFLTLLIF

SEQ ID NO: 94 - protein, 1358 aa, Unknown
  Acidaminococcus sp.D21
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 95 - protein, 653 aa, Oribacterium sinus
MELINSEEFTFKEELEKHTQVAMKQLSEFTYEDLEDSYFSVPVKRMIWQTLLVVREIEKVMGYAPKRIFVEMTRTEEEKGDKGRKESRGNQLLELYKSIKNTDSHNWKEEIAAADKDGKLRSKKLFLYYMQMGRDMYTGEEIDLGRLYDDNLYDIDHIYPRHYVKDDSIMNNLVLVNRRANQDIKKDLYPIPEQIKANPNVHMLWDALHKQKLITDEKYARLTSNTAFSEKQLGDFIARQLVETGQGTKGVADLLEQLFKDTVIVYAKASNVSDFRRDNGFLKSRLVNDFHHAQDAYLNIVVGNVYYTKFTKNPWNFICKDYEKDKEKNRYNLARMFDWNVVRGSETAWIVERKDEKGTISTVRKMMQKNTPLLTRMNFEQHGSIANATLYSAKKAKSENYLPLKTADEKMSDVKKYGGYTSMSIAYYFIVHHKEDKKENVTIEALPLYCKDKVEREENGLEKYCEEVLGYGEVNIIRRKLKIQSLLEFNGYQVHLSGKTGNQLILRNAISLCLSTKWITYIKKLEKAVNIQIVEEVVTPEENIKLYNLLADKHANTVYSKRPNAYGEKLLADREIFVTLEFGKQCEALLQILSLTKIGSTEANLLLIGESEHSGKILISKNLKASDRPAVINQSPCGLYEKKEWIFDKIVEK

SEQ ID NO: 96 - protein, 1436 aa, Capnocytophaga gingivalis
MKYIKYILGLDIGSNSIGWALIQLDLLQKTKRIIAAGSRIIPMDQKVLSDFGKGITISPTAQRTSYRNARHCRERHLLRRERLHRVLHILGFLPTHYDKQIDFSKRYGKFVDNTEPKIAYNEGKFLFMDSFQEMLSDFKSHQPDLFYTKKNGEESKIPYDWTIYYLRKKALSQKISKEELAWIILNFNQKRGYYQLREEEGNKENDFEIISSKIISVIKKDKDKKYNKYWYDIILENGLVYQAAFYNDFVYNWINQDREFIIERTSLKNGAEKVKLSYLPTFDEIDKMDKKEQDKYYKKIKIKTENSIGNKTVGCYIYDHILQNPNEKIKGKLVRTIERKYYKEELKAILEKQIALQPELFTDQLLADCIRELYSKNEAQQRNLAARDFVHLLVEDIIFYQRPLRRQKSTLANCSLESRSYIDKDSHTRKEAPLKVCPKSNPYYQEFRVLQWLQNLKIYEIDSDQEVTHQFIKTLEDKQQLFEFLMAQKEIDCEELLKYFLNQTYPNAKEKALKSELKKWKDTYRWNYVYDIGEKSSKKYPMNETRYELKRHLEKVANLPDDFLSSEVEYLLWHLIYSVKDKVAYEKGLKKFAQKHHLDKDSFVESFKKFNPYPSEYGSFSEKAIRKLLPLMRFGAHWDFNHIDKNTQKRIEDLITGVENEEIRTILREKAEKYQLEKETDFQDLPLWLAQYIVYNRHAEASSLEKWTSVNDLETYLNEFKQHSLRNPIVEQVVMETLRVVRDIWQQYGQGQASFFNEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSKENKTIKIFTEEQYRTFIKEHYSNNPEKTKKLLLEEIPEKMVARQMNDTCYISKFISEILSKIVRSDEQDEGVHSKNVILCTGKITSILRQDWGLNDIWDNLILPRFERMNNLLQKEKFTIYSIEKQKKIPVVPINDQFKSFQKKRIDHRHHAMDAIIIACTTREHINYINNQHALEKEKDKKEKQEERDKLREKLCIKKYNNRSEGNYSWIFKKPWDTFTQEVRVALEDIVVSFKQNLRVINKATNYYERWVEENGKYIKKMVKQEGTNWAIRKPLHEETISGKIYLDREKITKNDILTATRKTVDSSFDDKRIKKITDTGIQKILLNYLKYKGSPEIAFSPEGLEELNKNLSIYNDGKPHKPIYKVRIYEKGSGRFALGEKGRKYKKYVQGASNLYFGIYQGAKRSFATIPLNEVIERQKQGLPSVPEYNEKGDLLLFSLSPNDLVYVPIEGEIIENIDFRNLSKEQKERIYNVNDFSSTCYFTPNRIAKAIFPKEVDLQRKGDKLSGSYDTKTASLEGIQIKEVCIKLKVDRLGNISKA

SEQ ID NO: 97 - protein, 1069 aa, Bacillus cereus
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLQVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 98 - protein, 1391 aa, Lactobacillus jensenii
MKEIKDYIIGLDIGTNSCGYVVTDKQNNILKLKGKTAIGARLFKEGEAAADRRAFRTTRRRLARRRWRLSLLEEIFDEEMNKVDPSFFRRLKESDYSPKDRRKQFNSIVFESSEADKAFYEKYPTIYHLRNALMHDNQKHDLREIFLAVHHIVKYRGNFLREDSVKAFKAAKFTLQGEDGIGPVDKLNDLLKEIYIEAAPELATDNLSKIEDIIKDKKLYKQDKLKQIANLLPKAVDSKDKAKLNKDIAKQVANALMGYMFRLDTLFSFTDVDVKDYKLKFSDANIDESLDALTSLLTDAQIEFVLELQSIYNTIVLNEIVPDGMSLSESMVKKYDDHKKDLKLYKEYIDSLSDQKKAKQLEAAYALYVNYRKADLLAAKKLFEKKKIGDKKFVDVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNFEEMVDTTESANQFIKRMTRKDTYLLAEDVLPKSSLIYQKFMILDELNRIKIDGKKLTSKLKHDIFEKLFKKQKSINLDNLKNYLLAEGNIPGLIEGLSDGINFNNSFSTYIDYRNIFGDEIDNPNKQADFEKMIEWSTVFEDRKIFKRKLKEITWLTPEQIKQVSSKRYSGWGRLSKKLLTQITDENGVNILQRLWNEPETLTEVLANPVIKRKISEANSLFVQINKVENILDDAYTSPQNKKAIRQVIRVVDDIIAAAHGKKPSQIAIEFARSSQNKAKVPDTRKKQLDKIYNKISSEILDSSIKNELKNLKSNKYLSKDKLFLYFKQMGRDAYTGDKLSLDQLQNYDIDHIFPRSFIKDDSLDNRVLTQKPINAKKSDYGIPALEFGNKYVPDLGITVKEMWKLWQENGLISKSKLINLCTNPKKIGSKRASGFINRQLVETSQVIKLVAIILQAEFPDTEIIEVKALQNTTLRESFHLYKNRSVNDYHHAIDAYLTTIVGNYLYQVYPKLRPYFVYGQFKKFNQEKNIDILKRLKNFNFLRQLIFNTDDNIYISGTKEIVFNKKDIIHKLETAYGYKYMNISRECYQETSSLFNQTLYAHNSSVKNSLIPKKKGLPTEIYGGYSGNKDSFFVLVKIVKKRTNLYRIVGIPTRELAKLNSSNNYNQALNKIVESKLCLKETESFKILIKRLLYGTLIVDNGQKFRIGSFKEKHNVQQLVLQLKSMKYIKFYIDGGQNYFTDVERKKLEKQDRDKCLLYVFDDIMNVVNKRFTLFDMSKYEKDGDSLREKFNCLDFNDKVSILSDLLKAFHANSDRTSITKLKITNLGRHQAGKNGITLTTNAQIIYQSPTGLFERRIKIKDL

SEQ ID NO: 99 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 100 - protein, 1362 aa, Lactobacillus paracasei
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 101 - protein, 1056 aa, Actinobacillus minor
MKALNYILGLDLGIASVGWAVVEIDQNELPIRLIDLGVRTFERAEVPKTGDSLALARRLARSSRRLVRRRAVRLLKAKRLLKQEGILQADDFHSSHLKPLPNNPWELRVKGLNHLLDRKEWAAVLLHLLKHRGYLSQRKNESKTDNKELGALLKGVSENRQLLQAQAFSTPAEIAIKKFQQEEGHIRNQRGAYSHTFDRNDLLAELRLLFQKQREFNNPYTSQSLEQAIAELLMWQKPALSGEAILKMLGKCTFEPSEYKAPKNSYSAEYFVWLTKLNNLRILENGADRGLTAEERQLLINQPFEKAKFTYAQARKLLELSDLAIFKGVRYGKDNAESATLMEMKAWHAIRKALESNGLKTEWNGLKTKPELLDKIGTAFSIYKTDEDISQYLNGELSPAVLNALLENLSFDKFIRLSLQSLAKILPLMEQGLRYDEACKQVYGDHYGKKEQLELRFLPKIPVEDIRNPVVLRTLSQARKVINGVVRLYGSPARIHIETGREVGKSFSERRDISKRQEENRNERQRAVEKFKEFFPHFVGEPKAKDILKMRLYEQQHGKCLYSGKELDLNRLLEKGYVEIDHALPFSRTWDDSFNNKVLVLASENQNKGNQTPYEWLNGKENAERWKLFQALVNGSRFPYSKKQRILTKYLDEDGFRERNLNDTRYVARFLCNFIEDNMQLVGQGKKRVFASNGQITALLRRSWGIQKVREDNDRHHAVDAVVVACSTRALQKKITDYVRYKEMNVFTGEKIDQETGEIIKFHFPEPWKFFRQEVEIRVFSETPAEDVVIALPDRPQANHEFIQPLFVSRAPTRKMTGQGHMETIKSAKRLAEGLSVSRVPLTQLKLKDLENMVNREREKALYEALKVRLEKFNNDPAKAFADPFYKKGGQQVKAVRVEQVQKSGVLVRQENGVADNASMVRVDVFIKGGKYFLVPIYTWQVAKGILPNRAATQGKEEEYWDIMDETAIFQFSLYQNDLIKLVTKKKTIFGYFNGLNRATSNINIKEHDLDKSKGKDGIYLEVGVKLALSLEKYQVDELGKNIQPCRSMKKRPPVR

SEQ ID NO: 102 - protein, 1081 aa, Neisseria flavescens
MTAFKPNPINYILGLDIGIASVGWAMVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELAVNKFEKESGHIRNQRGDYSHTFSRKDLQAELVLLFEKQKEFGNPHISDGLKEGIETLLMAQRPALSGDAVQKMLGYCTFEPTEPKAAKNTYTAERFIWLTKLNNLRILEQGSERPLTDTERATLIDMPYKNKLTYAKARELLGLDDTAFFKGLRYGKDNAESATLMEMKAYHAIRRALEKEGLKDKKSPLSLSPELQDEIGTAFSLFKTDEDITGRLKGCLQPEILDALLKHINFDKFVQISLKALRRIVPLMEQGKRYDEACAETYGDHYGEKNSEEMLYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKAIDIRRLNGKGYVEIDHALPFSRTWDDSFNNKVLVLGSENQNKGNRTPYEYLNGKDNSREWLEFKARVETSRFPHSKKQRVLLQKFDEKGFKERNLNDTRYVNRFLCQFVADHMQLTGKGKRRVFASNGQITNLLRGFWGLHKVRAENDRHHALDAVVVACSTVAMQQKITCFVRYKEMNAFDGKTVDKETGEVLHQKTHFPQPWEFFAQEVMIRVFGKPDGKPEFEEADTPEKLRALLAEKLSSRPEAVHEYVTPLFVSRAPNRKMSGAHKDTLRSAKRFVKHNEKISVKRVWLTEIKLADLENMVNYKNGREIELYEALKARLGAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLMQKYQIDELGKEIRPCRLKKRPPVR

SEQ ID NO: 103 - protein, 1392 aa, Gemella haemolysans
MANKTWYLGLDIGSASVGWAATDTGYKIIRKNKKRLWGVRLFEEAKTAEDRRGYRSSRRRLARRKWRLNLLEELFTSEVKKVDENFFLRLKESQYHYEDKTHKVPYAIFNDKDYTDKDYYKDYPTIYHLRSKLMTEENPDIRKVFLAIHHIIKNRGHFLLQGQSFKDGNLNNLIKELLELDILHVGFEVTEEVVDKIADISLEKKTSKDKLNDIKELYPKEKQLLEVFRLIFGGKTSLDKLFAIDEYKELDAAIKSVSFKEKIYEEVRHDYEQVLSNYIELLDLAKLVYDSIILSDIKKEGKTLSESKVELFEKHRDDLLKLKNLVKNDSKLSEDKKVELYALIFKEDKDKGTNYVNYIRKSEEGKGCNYEDFKKFLVKELAKLEESSVKTEIIKDLELEQFLPLQRTKDNSVVPYQIHKEELVKILDNAARYHSFLNEKDESGYNVREKVIQLLEFRIPYYVGPLNSSKKAKEGGFAWSVRNTGYENTPVTPWNYSKVIDESASAEKFITNLTNKCTYLKGEDVLPKSSLLYSEFALLNELNALKYDGNRISLEARNTIIEKLFKQQGKKVTKTSIKNLLKAEGYIDGKGEITGIDITVKNDLKSYRDFKKILGNKFNSEHVENIILWITLYGESRKLIKAKIESVYGEVYSKDEITKMSRLVYKDWGRFSRKLLTELVSKKLYNEETGECLNIIGAMRQNNILFMELLADRFDYSKQIVEFNKELQEDVTEIAPEILDDLYVSPAVKRSIWQTVRIVEELKKIIGCAPAKIFVETTRSNQEKKKPTDSRKKQLELAYKAVKKDVKELEKEIGTINFDVLNDRLSSVEPSKLKAKKLYLYYTQLGRCMYSEEPINISELFDNNKYDIDHIYPQSKIKDDSFTNTVLVKRESNAAKTDRYPLGSDIQTPSNRRFWKFLKEKGLISDEKYNRLVRTEEFSDEELSGFIARQLVETSQSVKAVASILGELNPETSICYSKAENVSSFRQNFGKIKKGDRDSKNNDQLIKVREINDYHHAKDAYLNVVVGNVYDTKFTRNVFNFIKDKKDGRKYSLNKVFYENVSDSKTVAWEMDKTIHQVEKVMNNNNIMVTRRTSEQKGGLFDATVYKAKVAAKAKDGVYYPLKTSNSVVKDVAKYGGYTSIGIAYYSIFEYTIVNKKGEEKITRIIPIPIYISQNIKDSTALIEFGKSQIFCRAYEKIKDFKLLYRKLCIGSKININNYQYYIGGKSDERFYYDSAIQVTLDKKSEKYLKILSKYQNWKKENKDGELWENITKENNIELYNKLVEKMNSEIFTKKKSNKYNELNSEEIRNNFIKISVEEQAKVLLEILNLLTNKKSIFDLKSIDIKAARGKISFNLTSLIQFSIIEQSITGFYEKEITIIGDKGNDMENNNS

SEQ ID NO: 104 - protein, 702 aa, Helicobacter pullorum
MRKILKIDERIQFKEVDYTAKNPENKKFVEFKNLKKFCEILGAIVGDRALADSIARDMTLIKDEEELAQKLRGYGKFSQEQITQLSALHFSHHISLSLKALSEILPFMREGMRYDEACQEAKLQAKHNDKKSKFLPPFCESIYADELTNPVVHRAIAEYRKILNALIAKYGSVHKIHIELTRDVGKNFQEREKYKKEIESNYKARVQAMQECEKLGLTLSEGNILKLRLFREQNEICVYSGRKITLANLKEQGALEIDHILPYSRSSDDSYMNKVLVFTNENQNKGNKTPYEAFGGDSQKWGEIESLALRSGYPKKKAKRILDKGFGDREAGFKSRNIVDSGYIARLIANYTKEYLKFLPLDSHENTALIAGEKDSKIHVEAVKGMLTATMRHFWGLGSKNRYEHTHHAVDAIIIAYINAAMIQRFSQFRQNQESLKARFYAKELAKEEFKTQRAFFEPFSGFREQVLAKVGQIFVSRPPRKRARGALHEETFYSIDDKKLSETYGGKKGVQRALSLGKIRQIGTKIVANGPMVRVDIFKHTQSGRFYAVPIYTMDFALGILPNKAVVSGKDKDRIIKDWLEMDSCYEFCFSLFKDDVIEVQKRDMEKPELAYFVSLDASDGRIKVRHHCNDITKINENQKKLFSEAIEKEVVGRGSIQNLKVFKKYKVSPLGEIKEAKYEPRQPIALKTSPKKHRKQNNAQ

SEQ ID NO: 105 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 106 - protein, 1007 aa, Helicobacter canadensis
MKVLGFDIGINSIGWAFVENNELKDCGVRLFTKAENPKTKESLALPRRNARSSRVRLRRRRSRLLSLKHIISKEFGLHYEDYIALDGNLPKAYTGKIESIYKLRYEALSQAISKEDLARVILHIAKHRGYMNKNQKTSQDSEKGAILSAIKENSNKIKHYQTAGEYFYKELFENLRDGTKEFKNIRNKAMKNEKTGNMESTYYNTILASDLEKELKLILEKQQAYHNYSDTFIKEVLEIAFYQRPLKDFSHLVGSCTFYENEKRACKNSYSAWEFIALGKIINTLESIKKDTGEIFSNEIITQILKEVLDKGSLSYTKLRKMINLDEKVKFKGLKYDKEGVEKTNLIEFKKLKEFKKALGEHNLERKTLDEIATHITLTKDENQLKKQLEQYALSQNQIDALAELDFNDHINLSFKALYEILPLMEKGKRYDEACNELGLKAKTSNQKSEFLPAFCDSIFAQELTNPIVNRAISEYRKVLNRLLKKYGKMHKIHIELARDAGLSKEARNKIEKEQKENKDINDKAEKTCKEFGLKPNAKNILKIKLWREQGEICAYSGKKITIDDLKEDKALEVDHIYPYSRSYDDSYNNKVLVFIKENQLKLNQTPYEAFGSNQEKWSKIQVLAQKLPYKKKNRILDENFKNKDQIEFISRNLNDTRYATSLIAKYTKEYLEFLPLSDDEDISLKSGEKGSKTHVQTMNGMLTSVLRHAWGFSQKDRNNHLHHALDAIIIAYSTNSIIKAFSDFKKNQEILKAKLYAKKLTSEEYKNQSKFTGFEKYRSKILEKLDSIFVSKPPNKNTKGALHEQTFYSYQDILEEYKTQEGLKRALECGKVRKIGTKYVVNDRMVRLDIFKKDNKFYGIPIYTMDFALGVLPNKVVTIGTDKDKIKKEWKTIDETYEFCFSLYKGDLVLIQKKEMQESEFAYYNGFDISSASISLEKHDNKFENLTENQKLLFPKAKEGDVEVRGIGIQGLKVFKKYMVTPLGEIQETRTEARQNIQPRKKHGLR

SEQ ID NO: 107 - protein, 1397 aa, gamma proteobacterium N4-7
MTKNYISPIAIDLGAKFTGVALYQYLEGADCTQEVAKGLLVDDRGNVTWSQEGRRGKRHQVRGYKRRKMAKRLLWLILDSEYGIKREEVTEPLLKFINGLLNRRGYTYISEEVDEESMNVSPLPFSEMMPDYFNSSAPLLEQLAKLLSDKNKLVRFRAEGKIPSNKNEFKKLLDTALDGKYKDEKKELSEAWGNILIASENVLKSTVDGHKSRSEYLANIKEDIKSNEELEKQISSKEIDGFYNLVGHLSNFQLRLLRKYFNDPNMSGVSYWDEKRLEKYFYQWVQGWHTKGGTDEAEKKNIILKTKGAPLLKTLKSLSADLTIPPYEDQNNRRPPKCQSVLLSDEKLTMHYPKWKEWVGQLVKQNDNAYLNENVTLANALHRIVERSRSIDPYQLRLLISITDAEKRNDLAGYKRLKLSLGSEVDEFLLLVKNIVDETKEAREGLWFETENKLFFKCGKTPPRKEKLKSTLLSAVLGKNLSDDEQSSFIEEFWKSGTPKIERRNVRGWCRLASQVQKTYGVYLKEYGLQQLHKLEAGKKLDDKPLALLYKNSGLIASKIGEALNIEPDEVSRFASPHSLAQIFNIIEGDVAGFNKTCRACTYENIWRMQEEKVESLLTNQLLSEIHGERKVPLKSAMCTRLSADSTRPFDGQMASIIEHIARKIAQHKIAQINDVPKEFSIDIPIIIESNQFSFTAELEEIKRGRGSAKAKKAKELGEKSKAGWVSKTERIKTSSEGICPYTGAPLGGSGEIDHIIPRSLTGRTKKTVFNSEANLIYCSSKGNHDKGNRVYVIEQLNDKYLKKQFSTSDVNLIKKKIKTTIQRFTEGGEKLRSFSELSREDQKAFRHALFVPELKSEVTSLLAVKNITRVNGTQAWLAKKIASLLAEHLDKQGRDYTLSAHQIDPWSVSKQRKMLASAEPIWAKKDPQPAASHVVDAVCTFLEALEQPHTASRLKTISSTSFEKTGWRSALIPDLIKVDALDRRPKYRRYNIGSTSLFKDGIYAERFLPILIDENGLMAGYDIDNSLKAKGADVVFESLSPFLLFKGEEVGAQSLSDWQERIDGRYLYMSIDKVKAFDYLQEKVGEKDIAAELLNSIHFTQRKTELRAKFSDDSGKKMKTLDAIRKSLKLTVTVNEIGKRKEKCGFSGTIGIPAKSAWENLLDEPLLETYWGTKMPPQEIWEKVYRKHFPRNIPNQAHRKVRKDFSLPVVDSVSGGFRVKRKTPNGYNYQLLAIDGYSAVGFKKEGDNVDFKSPALVPQIAESKSVTPISSELVHLDKNEIVYFDEWRKIDISDSDLKQFVSSLELAPGSQNRFYIRFTVDEDQFERHFKSALRVNGIQDLDTVNKTFDWNREIPSLLIPPRSNLFLLETGQKITFEYIANGANAEVKKAYSLRRA

SEQ ID NO: 108 - protein, 1082 aa, Neisseria meningitidis
MAAFKPNPINYILGLDIGIASVGWAMVEIDEEENPIRLIDLGVRVFERAEVPKTGDSLAMVRRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHISGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 109 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 110 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYIGPLSKGDASTFAWLKRQSEEPIRPWNLQETVDLDQSATAFIERMTNFDTYLSSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 111 - protein, 1426 aa, Capnocytophaga ochracea
MKNILGLDLGTTSIGFAHIVEDENKEKSEIKELGVRIVSLTTDEQSDFEKGKSITTNANRTLKHGARLNLDRYQQRRKYLIDLLQKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTTENKGSKESVRLQAYQWRAEAISKQLSKEEVAYVLTEINNNLNNASGYLGAISDRSKELYFNRQTVGQYLYAKLQENRHNSLKNKVFYRQDYLDEFERIWETQASFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIREKVKAIFQTLGICTKILYFDPLLPVKEFEEQDSYQLWHLLYSYESDDSTSGNETLYRILEKKYAFKREHARILANVALQDDYGSLSTKAIRKIYPNIKENQYSTACEKAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKEFGIKNPTKSDIIRYRLYQELEHNGYKELYTNAPIARDMLFSKNIEIEHIVPKARVFDDSFSNKTLTFHRINSDKGEYTAFDYITSLNSEEELNQYLTRVENAYKTKSISPTKYKNLLKKASEIGDDFINRDLRDTQYIAKKAKEILFQVTKNVLSTSGSITDRLREDWGLVDVMKELNMPKYQSLGLTEVEERKDGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNTNKPAGTDKQQITLTPRGQLHKETIYGKYQYYINKEEKIGVKFDERTIAKVSNPVYREALLKRLQANDNDPKKAFAGKNALSKNPIYLDESKTKTLPEKVNLTYLEEDFSIRKDISPDNFKDLKSIEKVIDQGVKRILIKRLQAYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFDAVVRAQQGIPIIDKTYKQAEGWQFLFTMKQNEMFVFPNATTGFNPAEIDLLDPKNKKLISPNLFRVQKIATKDYFFRHHLETNVETDNILKNVTWKREGLSGLKDIVKVRINHLGDIVSIGEY

SEQ ID NO: 112 - protein, 1424 aa, Unknown
  Parabacteroides sp.D13
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYRSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 113 - protein, 1395 aa, Lactobacillus jensenii
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 114 - protein, 1140 aa, Roseburia intestinalis
MRENGSDERRRNMDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRTGCSWSEKGYILTPRNKAENYQHTMLRAMLVEEVKEIFSSQRRLGNEKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTAHKPYGEWKVMEDKDFLFSLYSRDLIHIKSKKDIPIKMVNGGMEGIKETYAYYIGADISAANIQGIAHDSRYKFRGLGIQSLDVLEKCQIDVLGHVSVVRSEKRMGFS

SEQ ID NO: 115 - protein, 992 aa, Treponema vincentii
MQKNSGEDENCGFEFLTEEEKELIKPLFFRISKPSFQFADIEKKLKGKNGFWKFNYRKDTNVSGCPVSAGLKNIFGDEASAESWKDKKVGQYDMCDIWHVLFDFDDEEKLLEFAKRKLFLSDEAAKKFCAIRIQQGYANLSLKAIRKITPFLRKGYIYSTAVFLANIPFMIGRDIFLQNEKEIEDSVKNIIGTLRDKNNIIVLANRCIESAFKDKDNDFRFEEWDKALVENSAWDLFGKKKWNEYDEEKRKTIISQVSEKVEDNLKIAVGKNPNDYKYPLLRTDDLIMDYLNQKGFVVKGELYHPSDTDYNFETPVPAEDGKIYLASPRSPSVKNPVVMRALHQLRKLVNYLIKTGKIDSTTKINVELANDVNDKNQRKAIEELAKTNEKNNADARKKIEELCNEAGFKVVPTESDIKKFRLWKEQNETCPYTGKHISFTDLFGPIPKFDFEHTIPRSLSYDDSLENLTLCDSEFNRNIKKQRLPSELPDFEEINKRFLKFYEDKIDNCLRIIELNSKSGGSYEEPAVKDLRIVKKHKAQYELNYYKEKLRRFSSTEITSGFKHSQLNDTRIITKFSLSYLKGVFDHVQPVKGSMTDTFKRQWGLMERNEIKDRSNHTHHTVDALTVACINRGKFNLLSEAIKNSSDGKHLKFPKPWETFDTDVLNAVRYIIPKYFSDESSLRQSKKILRGRDGKPVLKNGKAVFIQGATARGSLHKDTFYGCIKTVPEKGGKSEMIFVQRIPVSTLDEKVAEKIIDKRIRKTFEKNLSTGIQTLQEIQTDGILLPFKKEGRDVFVKRVRIKAHPTSPIILKKHHNVINKNPKDYKQNYYVENEENYLLAIYRGKDAKGKDVSDHKLCNLLNAVKSRQNKTGFYPDFKEKKGINLQLYKVLKIGKIVILQNDIQEDVFALPKEKLWKRMYRIAGLATSRNDIQIKLVHIIRETPWGYMKGEKDLNAGKECLLYGTANFKGLVEGQDFTVSPAGEIIQKARVC

SEQ ID NO: 116 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 117 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 118 - protein, 1234 aa, Prevotella tannerae
MPNFWSIFTENLQTYLMKTRILGLDTGTNSLGWAVVDRDENNQYTPICRGDLIFTEGVKQEKGIEFSLAAERTSYRASRRHYFRRRLRKVEVLKVLVKHKLCPPLSDEALNRWHTKKEYPLDEDFILWQRTNEADNKNPYHDRHICLHRKLNLKDSQTDRYTLGRALYHLTQRRGFLSNRLDQNEEAEETGKVKSAISELSKEMKEAGCEFLGDYFYLLYRTEGNRVRIRSRYTDREKHYLQEFKEICRVQELDEDLAKALEKTIFFQRPLKSQRQGVGKCTMEKGHSRCAVSHPLYEEYRLLCYLNNIRIKTPSDDRLRPLNAEEREKITPLFYKEKNFDFEKIAKKLAGKTPFGWIRDAEDWPYQFNYRMTQEAPACPTTAQLIKVFGEDWKAALAETYTMSAKQDGTLKTEDEICTDIWNVLYSFSSKEKLKEFGLKKLQLDEVQAKAFSEIRLTRDFASLSLKAIRKILFFLRTGEDYSKAIFLANIPTIVGEEIWNDIERRSRLLYKVDLALRPQEERDAEEHRTIAERIKAAVAAEVPDAPIDLLYHPSMIEAYPDAKRNERFDCYQLGSPKTNAVRNPMAMRSLHMVRKVINHLLRKHIIDEKTEIHIEYARELNDANKRQAIADWQRELSKRHTAYAQNIRQLYKAETGLVIEPTKADILKYQLWEEQQHVCLYTGKKIGIADFLGANPKFDIEHTIPRSRGGDSTQENLTLCESKFNRDIKRDKLPTELANYEEILARIEHWKKQCYALKLKRDGIRTHSGLEKSIKDSRIRRRHLVGLEYGYLKGKYDRFTMKEVPEGFSRRQGAGIGLISKYAGLFLKSLFKDPKNPNRSNVYVVKGAITAEFRKLWGLQQADEAKSRENHTHHCIDAYTIACIGPCEYAALAAYYRSDEEFKYGRRREKPQFEKPWPTFTEDLLKLQEELLIVHQTTDKLGKRDRRKVKTPRGKFLTGGDSARGRLHQETYYGAINYDGNIKYVVRKPLDSLTEKDLDKIVDETVMGIVKGAVEAKGSLKEALADGIYMNKEKGILIKRVRIFSDVSEPINLKQLRDVSTKEYKRHIHLRKDENYLFAIYEGIDKKKNKKQTETATVDYLDAAKFYKDSKRRDKANSLVGDYSKKNKLPLKCILKKRQMVLFYEHSPEEIRFKDKKDLSRRLYIVTSIAKDGRVKFLHHQAATATGIQSSPSPFTNDGEHQPYYRLSASNIKVLVAGIDFDINILGEITPKL

SEQ ID NO: 119 - protein, 1496 aa, Prevotella veroralis
MKTILGLDLGTNSIGWAKVCVDDNGNYLRDIKLGSRIIPMSQDVLGNFDKGVTESQTSVRTGFRGVRRIRERSLLRRERLHRVLHVLGYLPPHYDSAIGWNKNEPSTYGKFLNHGEPKLAWEHKEDGSMRFLFMESFHEMMADFAKSQPSLVSDGKKIPLDWTIYYLRKKALSQPIRKEELAWLLLNFNQKRGYYQLRGEEDDDNPTKCEEYYELKVVGIEADEEGKNGNTWYNVKLENGWIYRRQSKIPLDDWIGKVREFIVTTEYEKDGITLKKDKNGDVKRSFRSPSEDDWGLRKKRTEKLLDSSKMTVGAFVYDHLLAEPSDKIRGKFIRTIERKYYKKELYAILCEQSKYHEELRSGDYLNKCAEELYKNNQPHRNSLLTKDLAYLLLEDLIFYQRPLKTKKSLIAECPYEAYKYVDKETGEIKRQGIKCIAKSNPYYQEFRLWQFISNLRLFNKADDKEVTADYLPTQDDYVRLFAYLNDRKEINQETLLKEFFKLKKITVNSEKVFPIRWNYIEDKEKKYPCNETRHELLLALDRARIDHSWLEKPGQEYRLWHLLYSVESKEETKEALRKLKDDDAFVESFLKVKPFKREYGAYSEKAIKKLLAVMRMGSLWRETDICDTTKGNITKILQGEIDEKLKEKISASVSSYNQLSDFQGLPVWLACYVVYGRHSEAAEIQHWKTPESLLAYINGFKQHSLRNPIVEQCILETLRTVHDIWKEVGHIDEIHVELGRNMKSTADQRARISENVLRNENTNLRIKSLLLELKNDPNIKDVRPYSPMQQEKLRIYEEGVLQELTKDDKDFTEITKISTMAQPSAKELQRYKLWLEQKYRSPYTGKSISLTKLFTSAYQIEHVIPQSRYFDDSFSNKVICESEVNSLKDNMLGYEFIKNHGGEIIHCTMLGDVKVLSESEYKAFVNDHYAHNKRKRENLLLEDIPQEFLNRQMNDSRYISKVVKALLSNIVRAEGEEEATSKFVVSCSGGITDRLKKDWGLNDVWNKIVYPRFERLNRLTGTEAFGQWENKDGKRVFQTAVPLELQRGFNKKRIDHRHHAMDALVIACTSRNIINYLNNESANNPKKREDLRQKLCDKNRTIRKPWETFTQDATAALEDVIVSFKNYVRIINKATNYYERYDVEGKKVIAEQRGDDMWAIRKPMHEATYYGRVNLRRKKKVNLRVALENISSICDNKLRIYINGLVEKGFNTKQILDKFKNTNDHFSMQKIDKVEIWQFTNEEEKLVATRKPLDTSFDTKKIASITDTGIQTILLNYLETKGGDSTIAFTPEGIVEMNQNISKYNNGKEHMPILKVRLYTKLGKKIPVGQTGCKAKQFVIAEAGTNLYFAIYEDEEGKRSYRTIPLNEVVERLKQGLSPVPEKNDKDVHLKFYLSPNDLVYVPIEDEHESLAKDHIYKFVDSSGTTANFIPHRSANVIFELNKKDAEKFCSGSIIQNEYGVGSSQSKNQKAITGEMIKAVCRKLEVDRLGNVIKVI

SEQ ID NO: 120 - protein, 1082 aa, Neisseria cinerea
MAAFKPNPMNYILGLDIGIASVGWAIVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNTHALQTGDFRTPAELALNKFEKESGHIRNQRGDYSHTFNRKDLQAELNLLFEKQKEFGNPHVSDGLKEGIETLLMTQRPALSGDAVQKMLGHCTFEPTEPKAAKNTYTAERFVWLTKLNNLRILEQGSERPLTDTERATLMDEPYRKSKLTYAQARKLLDLDDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGNRYDEACTEIYGDHYGKKNTEEKIYLPPIPADEIRNPVVLRALSQARKVINGVVRRYGSPARIHIETAREVGKSFKDRKEIEKRQEENRKDREKSAAKFREYFPNFVGEPKSKDILKLRLYEQQHGKCLYSGKEINLGRLNEKGYVEIDHALPFSRTWDDSFNNKVLALGSENQNKGNQTPYEYFNGKDNSREWQEFKARVETSRFPRSKKQRILLQKFDEDGFKERNLNDTRYINRFLCQFVADHMLLTGKGKRRVFASNGQITNLLRGFWGLRKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHKYVTPLFISRAPNRKMSGQGHMETVKSAKRLDEGISVLRVPLTQLKLKDLEKMVNREREPKLYEALKARLEAHKDDPAKAFAEPFYKYDKAGNRTQQVKAVRVEQVQKTGVWVHNHNGIADNATIVRVDVFEKGGKYYLVPIYSWQVAKGILPDRAVVQGKDEEDWTVMDDSFEFKFVLYANDLIKLTAKKNEFLGYFVSLNRATGAIDIRTHDTDSTKGKNGIFQSVGVKTALSFQKYQIDELGKEIRPCRLKKRPPVR

SEQ ID NO: 121 - protein, 1512 aa, Fibrobacter succinogenes
MKKILGLDLGTNSIGWAVVNADEITRDDGSRYLKPNGISAAGSRIIPMSADILGDFEKGNSISQTAERTRMRMARRLHERALLRRERLLRVLNLLDFLPKHFADKIDRYGKFTDDSEPKLAWRKNTEGKYEFIFQDAFNEMLAEFKDKQPEIVEEGKKIPYDWTIYYLRKKALEKALSKEELSWILLQFNQKRGYYQLRGEEEEIPQDKKIEYLAQKVVKVEATDQKKGDDVWYNVYLENGMIYRRTSKAPLDWEGKVKEFIVTTEVENDGETPKKDKEGNIKRSFRAPKEDDWTLLKKKTEADIENSHKTVGCYIYDSLLNNPKQKIIGKLVRTVERKFYKEELTQILKKQVELIPELRDDNLYKQCIEELYPINEAHRNTIAKTDFANLFINDILFYQRPLKSKKSQIDNCPYEERIFIDSKTGEKKKVPVKCIAKSNPLFQEFRLWQFIQNLRIYQREKEIDGKLLTDIDITSECLKSEEDYVRLFDWLNDRETIEQEDLLKHLFNTKKSKNKENPYRWNYVEDKVYPCNETRATILKGFSKCGINASVLSPELEMALWHILYSVEDKKEIETALTHFAQKQGWNDDFAKVFSKAKPFKKDYGSYSEKAIKKLLSLMRMGKYWNQDNIDKNTLDRIDKIINGEYDEKISNRVRDNAINLKDISDFRGLPVWLACYIVYDRHSEAKDCTKWNSPEEIDSYLKKFKQHSLRNPIVEQVVTETLRTVRDIWIQEEQIDEIHLELGRDLKNPADKRKKMSENILKNENTNLRIKAMLMEFMNPSMGIENVRPYSPSQQDILRIYEENALDNLTKDDKDFDFISKISKQAQPSKTDIIRYKCWLEQKYRSPYTGKTISLSKLFTPAYEIEHVIPQSLYFDDSFSNKVICEAEVNKLKDRQLGYKFIAEHHGEKVQLSQGEVVEILSVDAYEKFVKENYANNRIKMKKLLMESIPDEFIERQLNDSRYISKVVKGLLSNIVREKIDDENYEPEAVSKNLISCNGAITDRLKKDWGMNDVWNSIILPRFIRMNQITGKDCFTTTNAEGHLIPQMPLELQKGFNKKRIDHRHHAMDAIVIACTTRDHVNLLNNEAAHSKFNATRYQLQRKLRRFEKAVIDGKEREVAKEFLKPWDSFSSDSKNILENIIVSFKQNQRVINKTTNAFLHFDENGKKTFIKQGKGDSWAIRKSMHKDTVFGEINLRKVRSVSLNEAIKVPERVLNKKIKEKILELKNNKIDAKNIKKYIEENHTGGYGIDSSKIDVFYFTKETKERFFATRKTLDTSFNQAKIKDSIADSGIQKILLAHLKSKNGDAEQAFSPDGIDEMNKNIVELNNGKFHQPILKVRVYEKADKFAVGQKGNKKVKFVEAAKGTNLFFAIFEKDGKRSYLTIPLNVMIDCQKQYGNQWKNNIEAYLKEKELVEKDVKLQFILSPNDLVYLPTEGSIDKKRIYKVVSFTNNRLYAIPYAIAKSIVDKNEFTQLNKIEFTDNKESIKDACVPVIIDRLGNVIEFNGKRL

SEQ ID NO: 122 - protein, 1259 aa, Streptobacillus moniliformis
MKYILGLDLGVASIGWAVTEINEKGEPVGLIDANSVIFKPLDNDKGKLYNVERRDKRGSRRILRRKKHRVERTKMLLVNSSFLTNEEIDNLYVGKLDNIYEVRLKGLKEQLSKNEIARLMIYYCKNRGFKSNRKTEDLEILKSLGEKISEKDSDEKKLKPIIAKNTELIESKGLTPIEVIYMIRENDNSILGFKNKEGNYKFGFKRNQVIDEVRKILGTQQILSKEIVDEYIDILSSQRDFSDGPGGDSKYKIDYTKLAGKCKYTGEVRAVKSAPSYEIFTMLQKLNDIRYVKFTSEDKIEKKKLSKEVIHKLYDLVVEKNKTLTYDLIEKSIDEENIKLLNIPKLSKSKYVELRKSYFKERNDNENLTEEEINAFNEKLNNERMKQELIRNNLKAYKELKSKFKKNNIDENRIKELGGIYFLDLVAELLTYSKTDEKLEYFVENVERYSLFKEQRDIVEIIKTFPNYTKNGNLSLSLVRELNKLLMEGHDYESSLSSLNYYIDTDVDWEKFPTISEIEDSLSTKITNPNVKHILVILRKLYNTLLFKYGRPEKVHLELSRDFSNDFSTRNKIQKEQLENKVRREVAAFEMYGANKDIVAGKDRLSNDDFVRIKLWEEQNKVCMYSGRTIEKYQLTSAEVQIDHILPYSKSFDNSYSNKVLVFSNENQDKKERTPYQWLKGTEKWNEFKQRVRLNLNISNKKKENLLFEDEVVNNEFLERELHATSYSSRLALNIFQRLIPVSDEDKYDEHGNEKVKYLYNRNVIAFQGKMTSMLRNLYSLNKYTHSFESDTLDIDNKAFILKEFEINKDNLKMTAYNVNTGLEITSETKVEKNKSGEFKTIKDELLKKELDKKENLIEISDYFKDKVLFDLKIVDFEEIDTVEPEIISILYKMITALKEEVYSKNRENHLHHSLDAFLLTIMNRSMQMKLIKYNQLISVLKNKEIEIFNEEKGEYIDSKEFAEELQKQKIIDIDGNERGIKFNVNGKTHRLNLVKPYENFLDDIKNKIFDKRENNKLPYHVVKSKVSGALHAETILGESKGEITKRISVFDINYKNLGKIFDKDGSQKEIYETLVKWLEAKSKDYPKLKNGNIIKKVKIVDGNKDKLIKLGNKRYVEMGRTTVKILVLKKEAEEGLKFASIGRYKYNLLKSEKDVNISIWKDAIHFCKVRYNKLKENGYRLIHELIPGETIELELNKGNISKCLVVGFSGGKIEISSVIGDALDLINDKISTRIKERYYITVSTIKSIKKINKNILGD

SEQ ID NO: 123 - protein, 1091 aa, Mobiluncus mulieris
MDSRKYRVGIDVGTNSVGFAAVEEDDSGSPTRFLNTMVVIHDSGVDPEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 124 - protein, 872 aa, Candidatus Parvarchaeum
MLGSSRYLRYNLTSFEGKEPFLIMGYYKEYNKELSSKAQKEFNDQISEFNSYYKLGIDLGDKTGIAIVKGNKIILAKTLIDLHSQKLDKRREARRNRRTRLSRKKRLARLRSWVMRQKVGNQRLPDPYKIMHDNKYWSIYNKSNSANKKNWIDLLIHSNSLSADDFVRGLTIIFRKRGYLAFKYLSRLSDKEFEKYIDNLKPPISKYEYDEDLEELSSRVENGEIEEKKFEGLKNKLDKIDKESKDFQVKQREEVKKELEDLVDLFAKSVDNKIDKARWKRELNNLLDKKVRKIRFDNRFILKCKIKGCNKNTPKKEKVRDFELKMVLNNARSDYQISDEDLNSFRNEVINIFQKKENLKKGELKGVTIEDLRKQLNKTFNKAKIKKGIREQIRSIVFEKISGRSKFCKEHLKEFSEKPAPSDRINYGVNSAREQHDFRVLNFIDKKIFKDKLIDPSKLRYITIESPEPETEKLEKGQISEKSFETLKEKLAKETGGIDIYTGEKLKKDFEIEHIFPRARMGPSIRENEVASNLETNKEKADRTPWEWFGQDEKRWSEFEKRVTSLYSKKKISERKREILLNKSNEYPGLNPTELSRIPSTLSDFVESIRKMFVKYGYEEPQTLVQKGKPIIQVVRGRDTQALRWRWHALDSNIIPEKDRKSSFNHAEDAVIAACMPPYYLRQKIFREEAKIKRKVSNKEKEVTRPDMPTKKIAPNWSEFMKTRNEPVIEVIGKVKPSWKNSIMDQTFYKYLLKPFKDNLIKIPNVKNTYKWIGVNGQTDSLSLPSKVLSISNKKVDSSTVLLVHDKKGGKRNWVPKSIGGLLVYITPKDGPKRIVQVKPATQGLLIYRNEDGRVDAVREFINPVIEMYNNG

SEQ ID NO: 125 - protein, 1229 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDIREIYLAVHHIIKYRGNFLNGTPMRSFKVENIELNTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKGIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRHLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIEREKKVVAPETGEILWSNVAPNETIKQIKKVYNYKFMIVSREITTRRAELFNQTVYPKNYRGKLIPIKEDRPTDLYGGYSGNTDAYLAIVALEDKKKGKYFKVVGIPTRAAAKLEKLKQQDSQQYLQALHEVIAPQFTKSTKKGIKKTEFEIVLDKVHYRQLVQDGPVKMMLGSSTYKYNAKQLVLSEKAL

SEQ ID NO: 126 - protein, 1398 aa, Veillonella parvula
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYNDQDYFKEYPTVYHLRSELMKSGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKIVEGLSDSKDKEYILSQIELQILLPLQRIKDNGVIPYQLHLEELKAILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKVVKEHLIEAVFKQDHKKMTKNRIEQFLKDNGYISETHKHEITGLDGEIKNDLASYRDMVRILGDGFDRSMAEEIITDITIFGESKKMLRETLRKKFASCLDDEAIKKLTKLRYRDWGRLSQKLLNGIEGCDKAGDGTPETIIILMRNFSYNLMELLGDKFSFMERIQEINAKLTEGQIVNPHDIIDDLALSPAVKRAVWQALRIVDEVAHIKKALPARIFVEVTRSNKNEKKKKDSRQKRLSDLYAAIKKDDVLLNGLNNEIFGELKSSLAKYDDAALRSKKLYLYYTQMGRCAYTGEIIELSLLNTDNYDIDHIYPRSLTKDDSFDNLVLCKRTANAQKSDAYPISEEIQKTQKPFWTFLKQQGLISERKYERLTRITPLTADDLSGFIARQLVETNQSVKAATTLLRRLYPGVDVVFVKAENVTDFRHDNNFIKVRSLNHHHHAKDAYLNIVVGNVYHERFTRNFRAFFKKNGANRTYNLAKMFNYDVNCTNAKDGKAWDVKTSMDTVKKMMDSNDVRVTKRLLEQTGALADATIYKATVAGKAKDGAYIGMKTKSSVFADVSKYGGMTKIKNAYSIIVQYTGKKGEVIKEIVPLPIYLTNRNTTDQDLINYVASIIPQAKDISIIYGKLCINQLVKVNGFYYYLGGKTNSKFCIDNAIQVIVSNEWIPYLKVLEKFNNMRKDNKDLKANVVSTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 127 - protein, 1485 aa, Prevotella bivia
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSFRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGIIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHALSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEYFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDIICNRKLKKYIKARLNEGLQKKQILNIFKELNNVWEGIDVNKIDIWEMSNDKEPMVATRKQLDTSFDEKKIRSISDTGIQKILLNYLITKNNNPELAFTPEGIQEMNSNISEYNDHKKHQPIYKVRVTEPLGAKYPIGTMGNNPKKFVEAQAGTNLYFAIYEDKEGKRNYDTIPLNIAAERLNQQLSPVPETNENNTPLKFYLSPNDLVYVPSEEERHSGNNIQLDKNRIYKMVSSTSKRCFFIHHRVAISLVDKKEFSAQNKMERSIDNEQVMIKSVCWKLITDRLGNIIKVIK

SEQ ID NO: 128 - protein, 1218 aa, Prevotella buccalis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYHEQGNKVRIRQRYTDRKKHYQHEFDAICEKQELSSELIEDLQRAIFFQLPLKSQRHGVGRCTFERGKPRCADSHPDYEEFRMLCFVNNIQVKGPHDLELRPLTYEEREKIEHLFFRKSKPNFDFEDIAKELAGKKNYAWIHDKEERAYKFNYRMTQGVPGCPTTAQLKSIFGDDWKTGIAETYTLIQKKNGSKSLQEMVDDVWNVLYSFSSVEKLKEFAHHKLQLDEENAEKFAKIKLSHSFAALSLKAIRKFLPFLRKGMYYTHASFFANIPTIVGKEIWNNEQSRKYIMENVGELVFNYQPKHRDVQGTIEMLIKDFLANNFELPAGATDKLYHPSMIETYPHALRNEFGILQLGSPRTNAIRNPMAMRSLHVLRRVVNQLLKESIIDENTEVHVEYARELNDANKRRAIADRQKEQDKQHKKYGDEIRKLYKEETGKDIEPTQTDVLKFQLWEEQNHYCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYHMEETFRQGRGSKPKFSKPWATFTEDVLNIYKNLLVVHDTPNNMPKHTKKYVQTSKGKVLAQGDTARGSLHLDTYYGAIERDGEIRYVVRRPLSSFTNPKELENIVDETVKRTIKEAIADKNFKQAIAEPIYMNEDKGILIKKVRCFANSVKQPINIRQHRDLSKKEYKQQYHVMNENNYLLAIYEGLVKNKVVREFEIVSYIEAAKYYKRSQDRNIFSSIVPTHSTKYGLPLKTKLLMGQQVLMFEENPDEIQVDNTKDLVKRLYKVVGIEKDGRIKFKHHQEARKEGLTIYSTPYKNNDDYVPIFRQSIKNINILVDGIDFNIDILGKVTLKE

SEQ ID NO: 129 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 130 - protein, 1487 aa, Prevotella timonensis
MKNILGLDLGSNSVGWALVKVEENGNPIGSIKMGSRIIPMSQDILGSFEKGDTVSQTAQRTLYRGKRRLIERHVLRRERLCRVLHIMNFLPAHFDRLLGWDKTDNKTYGKFIDDSEPKLAWRQNKNEMGKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKKKSDIPLYDWVGKTLQLIVVTTYEKDGKTPKIFDSGKQNPSYRLPKEDDWGLVKKRTESQLQSSGKTVGAFIYDNILSKPDDKIRGNLVRTIERKYYKKELIEILQQQAKYHDELHNQNLLESCAKELYAHNDVHYNEVIKSNMINLLVNDIIFYQRPLKSKKSLIANCKYESYEYVDKETGEIKEMPIKCIAKSNPYYQEFRLWQFIHNLRLSDVVTREDVTAQYLSTPQDYCNLFTYLNDRKEIKQDILLKDFFKIKKVQIDKEKVFPIEWNYIKDATKSYPCNETRYELLSALKRAGMDKQWLDDTPNMQYRLWHLLYSVEEKEESAKALRKLYDDDKFVTSFLKIKPFNKCYGAYSEKAIKRLLTLMRMGKAWNEQAIDAKTLKCIQQIITDNVDSKLKEKIDDSRYVLHHVSDFQGLPTYLASYVIYGRHSEVTDIQCWDSPEDLLKFIRDFKQHSLRNPIVEQVILETLRVVYDIWKAEKHIDEIHVEVAREMKLTAQQRNEANLRNLNNEATNLRIKYLLEELKNDTFIKDVRPLSPIHQEKMRIYEQAVLGNLNKQDKDYDDIIKISKKEHPTNAELIRYKLWLEQRYCSPYTGKAISLSKLFTTAYEIEHIIPQSRYFDNSFNNKVICEAEVNKAKGNMLGYEFIKKQGGQKIYCTQLGKAVTILKEEAYKQFVNEHYAHNKRKRDNLLAENIPESFSSRQLNDTRYITKTIMSLLSNVVRQQSEEEATAKNLLPSSGSVTDRLKNDWGLKDVWNTIVTPRFERLNKLSGTNDFGEMKEENGNRYFQTNVPLEYEKGFKKKRIDHRHHAMDALVIACTTRNMVNYISNANANSPKQREDLRQLLCDKNRIINKPWDTFTQDALKALNDIVVSFKNNVRIINRATNRYQRYDKNGKKIIFSQKGDDMWAIRKSMHKETVFGRVNLIRKEVLPIAKALDNISAICNAQLRAYVNDLVDKHFNKKQLVAHFKSLNYKWNRQDVSKVEVWISSDNKTPMVAVRKPLDTSFDKKKIASITDTGIQTILLNYLESKGGDASVAFAPEGIQEMNSNIELYNNGKAHKPIKNVRLSEPLGAKYQVGERGAKTKKYVEADKGTNLFFAIYEDEEGKRYYYSVPLREAIERQKQKLSPVPEYNEKGVALKFYLSPNDLVYVPTEEERTMGTCHIDKARIYKMVSSTGCSCYFVPSTFAKVIVDKVELQSLNKMEKAITDECIKEVCWKLKVDRLGNIINVIK

SEQ ID NO: 131 - protein, 1138 aa, Bifidobacterium dentium
MLCRCHRRYRIGIDVGLMSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 132 - protein, 587 aa, Neisseria subflava
MATSRSRIRSQTDAFGVVGSLVAFNQTSRLFVAKKNEGETADKELGALLKGVADNAHALQTGNFRTPAELALNKFEKESGHIRNQRGDYSHTFNRKDLQAELNLLFEKQKEFGNPHVSDGLKEGIETLLMAQRPALSGDAVQKMLGYCTFEPTEPKAAKNTYTAGRFIWLTKLNNLRILEQGSERPLTTTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYIEIDHALPFSRTWDDSFNNKVLVLGSENQNKGNQTPYEYFNGKDNSREWQEFKARVETSRFPRSKKQRILLQKFDEDGIYRIGVKTALSFPKYQIDELGKEIRPCRLKKRPPVR

SEQ ID NO: 133 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 134 - protein, 1354 aa, Prevotella melaninogenica
MADFAKYQPGMVADGRKIPLDWTLYYLRKKALTQAIRKEELAWILLNFNQKRGYYQLRGEEEEENSTKHEEYYELKVVSVEAAEEGKGGNTWYNVTLENGWIYRRQSKIELNDWVGKVRPFIVTTEYEIDGVTIKKDKNGEVKRSFRAPSENDWGLRKKRTESLLEESGKTVGAFIYNHILSEPADKIRGNFIRTIERKFYKKELEAILREQSKHQKELKDIDTLIACIKELYPNNKPHQDSLIKKDMTYLLITDLIFYQRPLKSKKSLIADCPYEYYEYVIKETGENKRQSIKCIAKSNPYYQEFRLWQFIINLRLFDRNNDKEVTSEYLSSMEDYTRLFTYLNDRKDINQETLLKDFFKQKKVKRGMEKEFPIRWNYIEDKEKKYPCNETRHELLTALGKVGIDHSWLDDKELFYRLWHLLYSVESKEEAEGALRKLVDNDDFVNAFLKIKPFKKEYGAYSEKAIKKLLAVMRMGNLWNEVDICEQTRDRIQNIIKGDIDEKIKDRMGRTFSQLSDFQGLPEWLACYVVYGQHSEATDIQRWTKPENLMAYINGFKQHSLRNPIVEQCILETLRTVHDIWKEAGHIDEIHIELGRGMKSTADQRARMSKSIMQNENTNLRIKSLLMELKNAKEFENVRPYSPMQQEILRIYEEGALQELTKEDAQYNEISKISQMAQPSANELLKYRLWLEQKYCSPYTGKPISLSKLFTSAYQIEHIIPQSRYFDDSFTNKVICEAEVNQLKSNMLGYEFIKKHGGEIVRCTMIGDVKLLDAKEYYNFVTEHYTNNRRKKEKLLMEDIPQEFLNRQMNDSRYISKKVMAILSNIVREEDEQEAKSKFVIACSGGITDRLKQDWGLNDVWNSIVYPRFERLNKLTNTENFGRWENKKGKQVFQTSVPLELQKDFSKKRIDHRHHAMDALVIACASNNIINYLNNESAKSQEKREDLRKKLCDKNRIIRKPWETFTQDAHTALENVVVSFKNYIRVINKATNYYEKYDKNGKKEIAEQKGQDMWAIRKPMHKETVFGQVNLRRKITIKLKDALEKIPAICDKELRDYINILVAKQFNKKQILAHFKSINYRLNMKSVDKVDVWQFSNEKEPMVATRKSVDTSFDTKRIATITDTGIQKILLNYLKAKNNDPNIAFTPEGIAEMNKHITEYNNGKQHQPILKVRVSEPKGAKYQVGETGNKRSKFVEAQKGTNLYFAIYEDKEGNRSYNTIPLNEVIERLKQGLSPVPDANEKSIPLKFHLSPNDLVYVPKTDEENEIKMGQIYKFVDSSGTTANFVPHRVSNLIYNVDKKIAENFCNHEIIQNEYGIGSPQSKNQKSITGEMIKAVCWKLEVDRLGNIHKIIK

SEQ ID NO: 135 - protein, 1130 aa, Streptococcus gallolyticus
MTNGKILGLDIGIASVGVGIIEAKTGKVVHANSRLFSAANAENNAERRGFRGSRRLNRRKKHRVKRVRDLFEKYEIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIRHNLPNQFTEGQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKISVIRGQFTSQLRRKWKIDKSRETYHHHAVDALIIAASSQLKLWEKQDNPMFVDYGNNQVVDKQTGEILSVSDDEYKELVFQPPYQGFVNMISSKGFEDEILFSYQVDSKYNRKVSDATIYSTRKAKIGKDKKEETYVLGKIKDIYSQNGFDTFIKKYNKDKTQFLMYQKDPLTWENVIEVILRDYPTTKKSEDGKNDVKCNPFEEYRRENGLVCKYSKKGKGTPIKSLKYYDKKLGNCIDITPEGSKNEVVLQSLNPWRADVYFNPETLKYELLGLKYSDLSFEKGTGKYHISQEKYDVIKEKEGIGKKSEFKFTLYRNDLILIKDTASGEQEIYRFLSRTMPNVKHYAELKPYDKEKFDNVQELVEALGEADKVGRCIKGLNKSNLSIYKVRTDVLGNKYFVKKEGDKPKLDFKNNKK

SEQ ID NO: 136 - protein, 1371 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 137 - protein, 1168 aa, Unknown
  Azospirillum sp.B510
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 138 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 139 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 140 - protein, 765 aa, Butyrivibrio fibrisolvens
MGITIGLDLGVASVGWAVVNDDYEILESCSNIFPSADASKNSERRGFRQGRRLTRRRKNRIHDFQKLWEDKGFVIPSQGTEDVLAIKIKGLSEKLSVDEVYWVLLNSLKHRGISYLDDADSGDNSSDYAKSISRNEEELKEKLPCEIQWERLQKYGAYRGNISIVEDGEPITLRNVFTTSAYKKEVEQFIDTQAKYNAQYSGDFKADYLEIFNRKREYYEGPGNELSRTDYGKYTTEINADGEYITVDNIFDKLVGKCSVNPDERRAAGASYTAQEFNVLNDLNNLTISSESSFIEDGKLTEDAKRKIIETIKNAKTVNVKKIICDVIGDKKCQISGARIDKNEKEIFHSFEAYNKMRRALEEIGFDISSLSRENLDLIGDILTLNTDRESILNAFNRKGIELADEAKDILVKVRKTNGSLFNKWQSFGLSIMNELIPELYAQPKNQMELLTAMGVFKSRGDRFLECKEIPGDLIVDDIYNPVVSKTVRITVRILNALIKKYGYPDRVVIEMPRDKNSDEEQQRLKKEQRDNENEIKDIKARVKTEYGREITEEDFRQHSKLSLKLKLWNEQQGICPYSGKSIKIDDLLDNPNLFEVDHIIPLSISFDDSRNNKVLVYSSENQDKGNRTPLAYLASVNRQWDIHSFMDYVLKTYAGAQKRKKRDNLLNEQDITKVEVLQGFVNRNINDTRYASKVVLNSLQEYFSSKECSTKVKVIRGSFTHQMRVNLKLKKTVMNHMFIMQLMQCLLLFHRWDMTLIMNLQISI

SEQ ID NO: 141 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 142 - protein, 1035 aa, Candidatus Puniceispirillum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 143 - protein, 1270 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 144 - protein, 1204 aa, Prevotella ruminicola
MERILGIDTGTNSLGWAIVDKDENQYHLVAKGTNIFSEGVKIEKGIESSKAAERTEHRSVRKHYWRRKIRKIRLLTILSDNDLCPRLKHEQLRQWRLKKVYPTDDTFMEWQRTEDKAQVNPYKFRYICLTQKLDLSDITQRFILGRALYHLNQRRGFLSNRKEATKESEGTVKEGISSLSKDMKDSGCEYLGEYFYQLYQQGKKIRNHYTARKEHYLKEFKAICSKQELDDALIEKLEKAIFDQRPLKSQKGQVGTCTFEKGKSRCPSSHPLYEDFRMYSFINNIKVQVDTLYDKGERSLTDEEKQLIIPLFKRKSKRTFPFEDIAKKIAGKNNYCYIKSNEEKAYKFNYQMDTQVSGSPVNAQLEEIFGEDWLSSVCEVYTLANNKSRFQIMNDVWHVLFFYDDEDKLKEFAKDRLQLDDELAEKFSKISIPNDYAALSLKAIRKIMPYLRDYGLIYSEAVFLANLVDVLPQHVWGIKEMREAAIENVIDVMHSYDKNNIDGITLEGCVKTFLKERYQVSDDNLKKLYHPSMLDPYPRQRPNDEGVFQLGSPRISSVKNPMAMHSLFRLRKVVNLMLKKGYITPDTKVHIEFSRDLNDANKRWAIQTWQRENEKERERCRKEIEKYIASPSDTDILKYQLWEEQNHKCLYTGDEIRITDFLGDNPKYDIEHTIPRSAGGDSTKMNLTLCSSRFNRDEKKTKLPAELVNHDEILERISNWKEKYEDIDKQIRKISTKGATSKEDKDSKIRRRHYLILQRDYWRGKYQRFTMTEVPEGFSRRQGTDISVISRYARMYLKSVFKQVYIVKGIATSDFRKMWGIQDEYAKKERVNHVHHCIDAITIACIGKAEYDKLADYRHQYDDYLFQGKTKPTFDKPWPSFVIDIKHIQDELLIAHYAKDNLEKFTKKNLRGKDGRIIRDKFGNKLQMKGDTSRNSLHNDKFYGAINHEGEIKYVYRTNIEALDAKSIGNIVDPTVRSIIESAIAIHGSLKAAINKGIWMNEEKHIPIKKVRVFRNDVKKPIELKDQRDLSDKDYKQHYYVTNDGNYMMLIFSKLNNKGREIRQHVVINSLEATEVIKSHKRSQVGKVVWESYYSKEGFDLIYKLKSGTMILLYENNRDEVWDLDIRNLQKRLYIITKMKYDGRIYMMHHQEAREKKDLEEKSGSFKINEDYRPLIVNSYNQFNALVQDLDFEINDLGEIRRLI

SEQ ID NO: 145 - protein, 1178 aa, Scardovia inopinata
MGKRHNSNMAKKKISYRIGIDVGLNSTGLAAIEVDDDGAPIRILNTMSVIHDGGVDPDAAKVRGTRLAISGIARRTRRMRRRRAKRLDRLEQILEKYGYTDTEPVLEEPYGPWICRAELADGFINDDEQRRMMIGIAIRHIARHRGWRNPYQNVRALLNIDDSDLSEEYKNLKEKVQDQINDGKDLPNFTPSQLVRDYLDNFSGQPAARIRTGKAGPRGNRRDAVGILPQRMRQSDYAYELQRIFDMQKIGRDEAQELLMAVFEAKSPKGSAEKRIGKDPLTGKKRALKASLAFQKYRIVATITNLRIKTGTGSERMLSPTELNDIYTYLLRVQDDNHLPTWEDICEEVLHIGRYQLAGIGKTFEGGERISNMPPVIQTSLAIHGLSEGTLAEKLTKWWDKADDDSRESMIKLLSNTVDIDRVNEVDENFASALDFIDSLDDEELTKLDKIALPRGRAAYSEEALNKLTADMLNTGDDLFSARQRIYHVNNSWRPPQPPIGEPLGNPAVDRVLKITNRYLMNCLNRWGQPRRVTIEHTRSGFTSVKQATEHQKISDKRAEYRRDIVKQLEEAGVESVHEYDIRRWEAVQRQNGQCLYCGRDITFKTCEMDHIVPRKGPGSTNTRTNFAAVCPECNRMKSNIPFASWAETKEAKDRGVSLDKAIKQVRFFNFTKNEYSPQAQRNFKKSMIERLKQKTSDEPLDNRSIESVSWMADELYKRIDWYFNHEQYETSKKAINDDKDNLSGTQVVVYPGSITAEARNAAGLGGNIHFIGGRYKTRLDRRHHAVDACVIAMMEPGIARILTERNQLRQAQRLTARIEDDEVNWKDYPTENTAGYNKYQAWSDRMHALLEYMNNALDYDKIPVVRWERLQLGNRSAHEDTIHPLKKLPLSHEISAIDINHASTPALYEALVSLPDFSEQDGLPADPSRQINVNGERYSGDDLVSFFNSNAAQIAIQGGSAELGTAFHHARIYRCWTVGKNGKKKIFFGMIRVYQHDLLHAKNEDLFTYPLKRSSVSMRYAKKEVVHAILSGNAEYVGYLCVGDELVLDLKGDKSNDEGGSRLSGQVGEFVQKFEEDSKVNSQIVNRWTVDGFPDEAKLRLRPSMFAGEGLKNMKSELVENAAIKNILSKTGWRVSVDVISKKSPVVLRRNAFGEPRWKTNAGLPVSYRWQDTETKE

SEQ ID NO: 146 - protein, 1371 aa, Gordonibacter pamelaeae
MNLRNVESYQVGLDIGTGSVGWAVLDDNGDLCRFKGKPTWGSRVFPTAETAAEARVHRGQRRRYDRRRQRIDLLQRFFADEVAKVDPEFFIRLNQARLHPENRDPAHADYRWPLFNGSNFTEKDYYRQFPTIYHLRAHLLKSDEPADIRLVYLALHNIVKHRGNFLHQDNPSLSARNANVGDAVEALCLALDEWCGAHDVECACDEAALAEALGDASLRPGEKRERAEAALGVEKAHKKLAKAVSSAVVGYAAEFGHVFFAESEGSKFALSNDEKVEAYVCPDEGRDLFDAMRAVHSSYVLMGILSEAQGELLSVCKVGEYERYKRDLETLKSLVRAYGPERYDEFFCGPFYEGTRDYDPGKAQGYTKYNLGASKLSHEDFLKEVQKLLKDIGAQADERYADIERAIEAGAFLRRLKTSDNGTIPYQLHLEEMDAIIERQAAFYPFLAQEKDKLKSLVSFRIPYYVGPLTQKNAARDGKGEARFAWSSRKPGMEDARVYPWNWEDVIDKDQSAEDFIRRMTGTCTYLKGEPVLARCSLDYELFCVLNELAGARWTQDGDKSYRFDAADRLGIVEDLFKKRKRVTYEAAEKWLARTHGPESGKSAGGAYHVSGGQGEDAFESQLSSHYDFCKILGVDELSDADEAMAEDIILWNTVFEDRSILKRKIKLAYGDRLGDAQVRKLCQKRYTGWGRLSGELLRGLRSATDNGPKTIMDILLEGDPNHARRMGAAMNLMEILHDDLLEFQAKIDEHNRERALAVGGMSVDEVTGSPALRRGINQALRVVDEIAGIAGKPPAHIYVEVTRDEGARNKGRRTTSRYRALEAALSSIKAQCADVYAELKERDPRALDDERLTLYFMQCGKCMYSGDALDINKLQTYQVDHILPQSYVKDDSFENKVLVRPDTNQRKGDTLLLDERLIARMRGFWRTLRDAELIGEKKFNNLTRTSVSDEQMKKFVSRQLVETGQMVKQVQQLLQARYPESEVQPVKAGVSHQLRVGCALAKSREINDFHHAHDAYLACQVGRFVQYRHSAVYSEPVKMAAVVKQFIKKQAEDYRRTRELPGSDGFIVSSFMTPGFDVKTGEVFRDAWDAGAEIDRIRRCFDYKDCFISRMPEETHGAFWDATIYSPRAAGKTLSLPLKRGLDPRKYGSYSREQFAYFFVYEAVKPKKKQRVLEFAPVPVRVASALANDPDALEDYARELAEAEGLVFERIRRRKVYKYQQIIVGDSRLYVTGREEVRNARQLAFSQDETKLICRIEQGEECEEGELLDLFRSMQRKYLACAPRLARLMKVAEMEEGFIAATASGKREVLLSLTSIAAAHRNSIDLKPIGRKGSSGQMKITFSKELSTNGILFVDSSVTGMFERRCRLGL

SEQ ID NO: 147 - protein, 1388 aa, Zunongwangia profunda
MKRILGLDLGTNSIGWALVNEAENEKEISKIIKLGVRVNPLTIDEKTNFEKGRPLSTNADRTLKRGARRNLQRYKLRRENLIEILIDNHIITKETPLTEIGKGTTYQTLSLRAKAVRERIDLEDFAKVLLAINKKRGYKSSRKASNDEEGQAIDGMAIAKELYERGITPGQYVLELLENDRKYIPDFYRSDLKQEFNKIWNNQKTFYPEILTDELFKELDGKNKSQTWAICQKPFNIKGIKRITKGREKTIENYHWRVKGLSGKLNLEKLAIILQEINNDINQSSGYLGGISDKSKKLYLNKETVGEFLYKQIAKNPHTSLKNQVFYRHDYLDEFEQIWKTQSNFNANLTDELKQEIRDVIIFYQRKIKSQKSLISFCQFESWEQEYFDKETGKTKTRTVGRRVIPKSSPLFQEFKIWQNLNHLVFTNSETDEKIEIKEVEQEIRKELFEELNLRGDLNPNDLLKILRSQFKIGKLSNWKCNFEKIEGNRTNAALFNIYQKISDFEGYGIDWNKSNAKKIRKELKATFPEIGIDASILEFDAYKKQLTNQSSYELWHLLYSAEEDFKISEQDKLIYGNSSVSLKKKLHLKFGFNPEYAKMLANLSLMSDYGNLSAKAIKKILPYLEDGHLYSEACRLAGYNHSKSLTAEELEKFEPKAKLDLLKKNSLRNPVVEKILNQMVNVVNQVIDTYGKPDGVRIELARELKKSAKERAEMTKGIADGTRRNEEIKKIITQKFGIPNPTKSDLVRYRLWQELESRGYKDIFTDKYISPDKIFSSEIDIEHIIPKALLFDDSFSNKTLSFRNVNLKKANRTALDFITQDYQSNVEAYKERVETWNKDNHISKGKRNKLLMSLKDIPDGFIERDLRNSQYIARKAKRMLYEVFPNEVLATSGSITDKLRSDWDLINVMKELNLPKYKALGLTEYEERLDKGTEELFKHEVIKDWTKRNDHRHHAMDALAVAFTTHNHIQYINNLNARKDITQDNHPIIKNIENLITEVNSKGKRVFKAPMSSFRESAKEQIEAILVSFKNKNKVVTKNINQTKKEGGFNYQNAKTPRGQLHKETIYGKSKQPLEKPVKINNRFCKKQVGLIINFKEQEAVLHHLKKYDNNEKIAFSNKTLKSDPIQVNGSPLREVKIFEEIFTIRKDINPDNFKTQKHLDKIIDKGIKEVMKKRLEEYNGDFKTAFSDLDKNPIWLNQSKGITIKRATISGVTNAEPLHQAKDHLGNIILDDNGKEIPIDYVSTGNNHHVAIYQDESGNLQEEVVSFYEAVIRKNQDQPIIKKRHPKGWKFLFTMKQNEMFVFSSENFNPSEIDLLDEKNAAIISPNLFRVQKIATKNYMFRHHLETEVTNNLDFTYRHFQATEWLRNLCKVRIDHIGRIVQIGEY

SEQ ID NO: 148 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 149 - protein, 1186 aa, Gardnerella vaginalis
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFTPWIFRAKLADEYIADEKQRKQMLSVAIRHIARHRGWRNPYQSIKSMTQETEYSEFYNELLKNIEKFAPGVSCEGSTPAQLVRDYLLSQQGKASRRLRITTDDRRKNHPNSLDPVLPRKLMQSDNMLEILNIFNVQHIDNKYVREQIINAVFYAKSPRGSAENRVGKDAITGKGKRALKASLAFQKYRIISTISNLRIRENSKERCLTIEEKQSVYKLLTTSTDEYSKEKSAEAPLYTWIDVADCLGIERYKLRGVGSQIEDGESVGNRPPMLNSELAILYANAKSLKQSLITWWLAANRTQEDKEAFIEILSNTVDIEAIHDNPEYQDKYGSVIAFIDSMDETEIAALENISLPNGRAAYSLETLDKLNKQMLETDDDLFEARKKLFNLPNNWRPSEAPIAEPTGNPSVDRVLKIVHRFLISAKNRWGNPERINIEHVRSGFQSKKMANSYKKLLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEESTYCKNHDISVDSAINRVRAFIFPPNSYDKRGASQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLELLNEEMRADRIAVVNSIRLRYSNSSVHKDDVHALLKLHVGDEIDSETIRRASTPALYCALTRNPDYDVNNGLPENTDRTILLHDKKLNADDSITFFKSKAAQLFVREGSVEIGNSIHHLRIYEYFEKLKSGKVKKSYGMIRVFQDDLHRYIHEDLFSCDLPEQSISMRYADTKVAHAVQTGNANYLGYLVPGDEIIVDFSHVKLSGYIGEFVEFLNKIGANCAAYKHWVVAGTDDKTTLILKPSMISSEGIDKLYSNCERNNFDYASYEKSIDKILVDKGWRVSVNVLDQYKAATIRRNALGEPRWASRSHLPISWSWDTGENRE

SEQ ID NO: 150 - protein, 1434 aa, Bacteroidetes oral
MKNILGLDLGTNSIGWAYVKQAQNDSEKSEIAELGVRVNPLTVDEKTNFEKGKPISTNADRTLKRGARRNLQRYKLRRQELIELLKDYQVISDKTILAEDGKETTFETLRLRVKSAKEQVSLEELARILLMINKKRGYKSSRKAKNEDEGQLIDGMEIARRLYDENLTTGQLSLQLLKEGKKSLPDYYRSDLQHELDKVWNFQKQFHPDILTDEFYTSIQGKGQKATRESFSSKYGIDTAENKGSREEKKLQAYQWRADATHKELTKEELAFVITEINNNINNSSGYLGAISDRSKELIFANETVGEYLWKQIQNDPHTSLKNQVFYRQDYFDEFERIWETQSGFYPQILTESLKNELRDILIFYQRKLKSQKALVSICEFESKEIPLKDKQGNPISKNGIPVTKLVGPKVAPKSSPLFQEFKIWQNLNNVLVRPKGSRKRKVTTNQQSTLLEGQEPVFELNLEQKELLFEELNLKGNLKTDYCLELIGYSAKEWEMNYPTLEGNKTNKALYEAYLKIIDSEGYDAKKLLKVKTDKDDINLDDIKVSASEIKTMISDIFNELGINTKILDFDAELERKQFEAQASYRLWHLLYSYEGDDSKSGNELLYRLLEDKFGFKREHSKTLANVSLLSDYGNLSTKAIRTIYPYIKENKFSTACELAGYRHSKLSISKEENENRTLKDTLDVLKKNSLRQPVVEKILNQMINLINELIEKHSEKDEKGNIVKYFKFDEIHIELARELKKNAEERRELDSKVREGKDRNEKIITILKSEFGLPYPTKNDITRYRLYEELKDNGYKDLYTNTYIPREKLFSKEIDIEHIIPKSRLFNDSFSNKTICYRQDNLNKGERTAYDYIEGLGKTQLDEYLNRVENLYTNKFITKAKYRNLLKKESEIGDGFIERDLRETQYIAKKAKEMLLQITRHVVSTTGSITDRLRDDWELVNVMRELNLPKYKVLGLTEIQERKNGQTVEVITDWTKRNDHRHHAMDALTVAFTKHSHIQYLNFLNARKDEKHKEYSNIMGIQQLETEKTTDKDGKDRRVFKTPIPNFRQVAKEHLESILISHKTKNKVVTRATNKIAGSKKQQETLSPRGQLHKETVYGKYRRYVQKEEKIGSKFDLQTIERVANPLYKRLLTKRLEENGGDPKKAFTGKNALAKSPIYLDETQTQQLPEKVKLVWLETDFSIRKDITPDNFKDEKSIDKVLDEGIKRILKDRLKSFDGDAKRAFTDLEQNPIWLNKEKGIAIKRVTISGVSNAEPLHTKKDHLGNEIFDDTGKPIPVDYVSTGNNHHIAIYRDENGNLQEKAVSFFEAVTRANQGLPTVDKTYNQHLGWQFLFTMKQNEMFVFPNKETGFDPQEIDLLDPKNKKLISPNLFRVQKISTKNYFFRHHLETSVETHNALNGVTYKSQLGLNGITDIIKVRINHLGDIVHIGEY

SEQ ID NO: 151 - protein, 1341 aa, Unknown
  Peptoniphilus sp. oral taxon 386 str. F0131
MWGSRLFEEASTAQDRREHRSNRRRLERRKYRLDLLEELFVEEINKIDPEFFIRLRESKFHFEDRSLKNTFILFNDKMEGGYNDKVFFSKYPTIYHLRSALINGNKEDVRAVFLAIHNILKNRGHFLLAGNDINISLSLNDTLTDLFEYLKIHLGIEVEFENKLKDIEKIALDKNLSKSDKQKKIVQLLETDYKKQLADVFKLSLGLTANMENIFGKENEQGLEFINAENKIKKIQFDSSYEENIAEFDQFYGEYFEIIDICKKIYDAISLSQILVDGKGLSESKVLSYEKHKEDLKLLKKVLKNIDKAYDNKGEDRLVYKVLKEDKDKGTNYVNYSKLSNNGTATTKEEFYKFLSKNLDLKKFGKLNKEDIETLDYINSEILLGRFLPLQKEKINGVIPYQLQMKELTQILNNASKYLPFLNKIEDGMTVKDKIISLIKFRIPYYVGPLNEYNRIENGNGFAWIEKKKNEKIFPWNFNDVVDIEKSAEKFINNLTNKCTYIKEETVLPKNSIIYSKFMVLNELNNLQYGNKKLDIELKMKMYTDLFLEKKDNRKVTEKRILEYFRINGINDGKEKLTGLNNEIHADMKSYRDMCEIMGENFNINVAENIINWITVFHGEKKILINKIKNVYGKMFNDEQISKLSKLNYSDWGRLSKKLLTDIKCYIDADGINFPVSILEAMEVSNKNLMELLSNKYEFISCIDDINNKYFGDRDISASELIDELYVSPAVKRGIWQSVRILEEIVSIIGHNPKKIFIEMTRHNEEKVQKSSRRHNLEELYKAIRKDPEYVELIKEFDSTTDTDSFKIKKLYLYFMQLGKCAYSKEKIDFDKLFTDSYDIDHIYPRSKTKDDSIHNNLVLVKAKYNREKTDVYPIDINIQKNMNSFWNFLYTKKFITEEKYKRLIRTSDLTDEELAKFISRQLVETSQSTKATAEVLKQIYGDSDICYVKAENVSDFRYGSSRQKDKNDIQKLFVKCREVNHFHHAKDAYLNIVVGNVYDVKFTKNPVNFIKKNKMGNKSNYSLNHMFCFDVERNGYKAWDSSETIKTVGRMMKSNDVRITKHVHPTRGELYDATIYKAKIAKTGSYMPLKSSKNTPLSDVTKYGGYTKIKIAYYSVYKYKFSDKNLIKTEIRLIPIPIYLSKNDDDIKEYVKNYLNDRVNSKLIDFTKIYDKLYVNSLIKINGYLYYLGGKTNDRVWIDNAVSIVLDDKIEYLIKRISNDIKYGYEINVSDDELMDIYESLAEKANKKIFYNRLSDFEKIFSNMDVKKKFVKLEKNDKCRVLLQLLNVLTDSQTTYKLEMVGLKHSRSNIGMKISNLEEFKVINSSITGLYSNEIDILNI

SEQ ID NO: 152 - protein, 1391 aa, Lactobacillus gasseri
MTKIKNEYIVGLDVGTNSCGWVAMDFQNTILRMHGKTAIGSHLFDAGNSAADRRAFRTTRRRIKRRKWRLKLLEEIFDPYMTEVDPYFFARLKESGLSPLDKRKNVSSIVFPTALEDKKFYCNYPTIYHLRYDLMSEDKKFDLREIYLAIHHIVKYRGNFLYNTPVKDFEASKIDVKDSLEKLNELYERLDSEFTVELDSSNALEIEKIIRDKKVFKINKVKSIHQLLSLKTENKERTKLIKDVSKQIINAILGYKTKFETILLKNISKDEADDWEFKLTDVDADNKFENLIGDLNENEQEILLEIRNLANAITLSNIVEEGKTLSESMIDKYNKHSDDLELLKQVISDHPDRDKAKKLALAYDLYVNNRHGKLLQAKDVLGSKKTLSKEDFYKEVKKNLDDSKASQEILDTIALDSFMPKQRTNENGVIPYQLHQLELDRIIKNQGKYYPFLKEVNPVSSHLKEAPYKLDELIRFRVPYYVGPLISPNESTKNKQTKKNQNFAWMIRKEQGQITPWNFDQKVDRMASANKFIKRMTTKDTYLLGEDVLPANSLLYQKFTVLNELNNIKINGKRISVPLKEELYNNLFKKNSTVTTNKLKSYLKENYNLINVEIKGLADEKKFNSGLTTYNKLRNLKIFDQQLDDLNYDKDFERIIEWSTIFEDKAIYKDKLKTIKWLSDRQIDKLSKIRMQGWGQLSKKLLSQLTDNNGQTIIEQLWDSQNNFMQIVNQSDFKDAIAVANQNLLVNTSVEDILNEAYTSPANKKAIRQVVKVVDDIVKAASGKVPKQIAIEFTRDADDKAKISQTRANKLRKVYKELSNELASETIRNELERVAKDQKLLKDKYYLYFMQLGRDAYTGEPINIDDLGQYDIDHILPQSFIKDDSLENRVLVKKAVNNGKSDNVPVKLYGNRMAADLGMTIRHMWEKWKDQGLITKTKYNNLIIDPDKINKYESSGFIHRQLVETSQIIKLVSTILQSKYPDTEIIVVKARYNHYLRKHLNLYKSREVNDYHHAIDAYLSAICGNLLYQVYPYLRPFFVYGQYKKFSSDPKKEKIIYDKTRKYNFISQIFENKSNDIISLETKKKVFDKKDIIEKLKHAYNYKYMLVSRETETHDQEMFKMTVYPRLSRDTKKSRNLISKKKDMPTEIYGGYTNNSDAYMVIARINKKKGTEYRVFGVPMRELVNLRKAEKNGRYNAYLKQVLEPEIMYSKNGKKNKTISSFEIVKAKVPYKQVILDGDKKFMLASSTYVQNAKQLTLSQNSMQAITDNCENDTEEEKALEEKALIEAYDEILTNIDKYLPLFDINKFREKLHAGREKFINLSLDVKKDTILQVLNGLHDNAVMPKIKSLGLSTPLGFMQFSSGVPLSENAKLIYQSPTGLFEKRVKISDL

SEQ ID NO: 153 - protein, 1426 aa, Sphingobacterium spiritivorum
MKHILGLDLGTNSIGWALIKQDFENKQGEILGMGSRIIPMSQDILGDFGKGNSVSQTAERTKYRSVRRLRERFLLRRERLHRILNVLGFLPEHYASQIDFTKRFGKFKEETEPKLVYSNEGFIFKKSFEEMLSDFKTHQPQLLEDNKKIPYDWTIYYLRKKALSRKIEKEELAWILLNFNQKRGYYQLRGEEEEENPNKLIEFYSLKIVDVLADEPQKGKSDIWYSLILENGWIYRRSSKTPLFDWKEKTRDFIVTIDLNDDGSVKTDKEGNEKRSFRAPGENDWTLVKKKTEQEIDSSRKTVGTYIYETLLKNPKQKIKGKLVRTIERKFYKTELKQILEKQKEFHPELRQDDLYSDCVRELYKNNEAHQLTLSKKDFVHLFMEDIIFYQRPLGSQKSSISNCTLEFRKYKDENGTEHTQYLKAIPKSNPYYQEFRIWQWMYNLNIYKKEDDTNVTKDFLNTKADFESLFEFLNNRKEVDQKALLKHFKLNDKTHRWNYVEDKKYPCNETKTMILSRLDKVENISDDFLTREMEQKIWHIIYSVNDKVEYEKALKSFAGKNNLEDNSFFEAFKKFPPFKSEYGAFSEKAIKKLLPLMRMGKFWNYNNISEQSKSRIQKIITGEYDENIKDKVREKAIHLTTETDFQGLQLWLVQYIVYGRHSEAAMLGKWNSADDLEEFLKEFKQHSLRNPIVEQVITETLRVVKDIWQKYGNGAKDFFREIHIELGREMKLPAEERERLTRQISENENTNFRIKALLAEMMDDNSVENVRPFSPMQQEILKIYEEGVLNSDIEIEDDILKISKTAQPSSSDLKRYKLWLEQKYKSPYTGQIIPLNKLFTPEYEIEHIIPQSRYFDDSFTNKIICESAVNKLKDNYIGLEFIKKLGGSIVECGNGKSVAILKHDAYEDFIKKHYANNRSKRNKLLLEDIPEKMIERQMNDTRYISKYISGVLSNIVRVEDGTDEGVNSKNIVPGNGKITTQLKQDWGLNDVWNDLILPRFERMNHLTNSTDFTAWNENHQKFLPTVPVEFSKGFSKKRIDHRHHALDALVIACATKDHVNLLNNQSAKSDTKRYDLKKKLMKFEKVAYNHPQTGERIEREAPKQFLKPWETFTIDAKNHLETIIVSFKQNLRVINKATNYYEKYVEKEGTKVKERVEQKGTNWAIRKPMHKETVSGKIDLPRIKVPKGKILTATRKSLDTSFNLKTIGSITDTGIQKILKNYLQYKDNNPELAFSPEGIEDMNKNIEKFNNGKAHQSISKVRVFELGSKFPLGQSGNKKEKYVEAAKGTNLFFAIYQDKNGKRSYETIPLNEVIERQKQGLSVVDLKGVDDFYLSPNDLVYVPSEDELENISMIDFNKMSSERIYKVVSFTGNQIFFVRQDIATSVVNKAEFSTLNKMERAIDGTMIKETCVKLQIDRLGNISKI

SEQ ID NO: 154 - protein, 1361 aa, Lactobacillus casei; identical to SEQ ID NO: 70

SEQ ID NO: 155 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKLAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 156 - protein, 1517 aa, Unknown
  Bacteroides sp. 20 3
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 157 - protein, 1399 aa, Olsenella uli
MNLRNTTDEYNIGLDMGTNSVGWAVTDKAGAIAHFKGKPTLGSRLFDAAQTAAGARIHRSQRRRYVRRRWRLDLLQSLFQDEVSKVDSEFFCRLRQSRLYVGDREKGHADYTWPIFNDSDFNEVDYYKRFPTIYHLRKWLMETDEKADIRLIYLATHNIVKHRGNFLRENNKSLSSRDANPAQAVKSLRLALNDWCSERDYECAWKGEEDDGAIDEAILNVLADGEKGRSDQAKEIAKLTGVDCGDAKQSKQCNEAIAKAIVGLKVEMKNIFGEFPAEKTSYIYLSSDEDVEAVRESCPDDSGELFQALCKLYSAYILQELLSYADPSGQTISANMVAKYKQYGRDLRLLKELTRTYAPQKYDLFFRGETYAGSSDYVVDEARGYTRYNLGTTKANYDDFQKSVKELFKGTDALQDERYQEMMVAFGEQKFLRRLKTSDNGSIYYQLHLEELHTILENQGKHYPFLLSEEDKIESLVSFRIPYYVGPLTRKNAAIGHDGKERFAWSSRKDGMEHAVITPWNWEEIIDRDKSAEDFIMRMTGDCTYLQGEPVLPKCSLLYEEFCALNEFNGAHWTVDGDDERRFDAAQRERIMCDLFRRTRSVTYNKVSDWLERKYNFTGARVRGGQGEHGFESKLGSYIFFCKDVFKTDGLDEADYTMIEQIILWSTLFEDRDILKRKIEEAYGGDRLTSEQIKVICKKRFTGWGRLSKRLLTDIKVNTDTGRKSIMDVLREGNPNNGQRSRTMVFMEVLRDEDLGFQKAIDGLNRDYFREHNNGLMDVNDLPGSPAIRRSINQAVRIVDEIASIARKEPTNIFIEVTREEDDPRKKGKRTKRRYDAIKSALEKFKKDDPSLWKELCEKAPGDMDERLSLYFMQRGKCMYSGRPIKIEELHTGKYEVDHIIPRSYIKDDSFENKVLVYREENQHKTDALLIDSSIRQKMGGYWRMLHDAKLVGDKKFRNLFRNHIDDKAMKGFVARQIVETSQMVKLVQTLFEARYPNTRIVPVKAGISHDLREAAGLVKCREANDFHHAHDAFLACRIGLFIQKRHPSVYDNPIGLARIMRDYARMQAREYKKSHCLAHTQGFIVNSFLSSGFDEETGEIFKDDWDAKAEVEGIRRVLNCRQCFISRMPVEGDTRYGGRYWGETIYSPKGKHKHEIPLKQGLDPNLYGGYSDLLYSYFLIYEASDVSSGERVLRFIGIPTSIAARMANQKRLEEYVSRLALQENLEHVRMVRKIMKKQLIEVDNCRLLVTAADAVTNATELAFSLDEMKIISTCAKCINGADPSAIDKIGNAQDSFFDNLKRRGSDRCALLFSQLKLDKLSQNFYMISSDDKSKILISILDRIRAKSNSVDLSLVGGAKHAAQMKFDFNAKLNNPASSFVLIDQSVTGMFERRTRIGL

SEQ ID NO: 158 - protein, 1398 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLSNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 159 - protein, 795 aa, Prevotella disiens
MEKQRILGLDPGTNSLGWAVLDFDNSKQEYNLVRKGEVIFEEGVGKSKRGEFSKAAYRTFYKSTRKHYFRRRLRKIEVLKVLVKYDFCPYLSDDLLKQWHEKKIYPAVKEFMDWQRTSDAEGKNPYYDRHCCLNEKLDLSLKSDRYVLGRALYHLTQRRGFKSNRLIQNNDENEEGKVKKGISELSTEMQEANCNYLGDYFYKLYTEKGNTVQIRKRYTDREKHYKNEFNAICEKQELNETIVKELDKAIFFQRKLKPQRHGVGKCTFEPNNRRCAISHPDFERFRMLCFINNIKIKTPFEENLRPLNNEEKALIEPLFYRKSIKNFDFEEIAKKLAGKNNYCYIKDDSSKQYKFNYRMSQGASTCQTIAKLKSIFGEEWKNGIAETYTNRRKKEGLKKQAEMVDDIWNVLYSVSECDVLKDFAINKLQLDEKTADNFSKTKLAQGFATLSLKAIRKILPFLEQGFGYTEAVFLANIPTVVGKEYWNNEDIRNDIMEEIKTIFYHNTLKTNDSHNTILFCIKDILSNNFDLAPGAIDKLYHPSMINVYKDVIPNEDGILQLGSPKIDAVKNPMAMRSLHIIRKVVNELLREGIINSDTEVRIEYARELNDANKRHAIADWQKKQYGKHQKYRKEIKELFKAETGFEIEPNETDILKFELWEEQNHICLYTGQEIGISEFVGENPKYDIEHTIPRSLGGDSTKMNMTLCENKFNRENKQKKLPSELANHSEILERIDDWKKKIYILQKKYDSIRTHNGMDKENKDKKIVSMQVRISGSSICVYSQNTLLWLQYGYN

SEQ ID NO: 160 - protein, 1428 aa, Burkholderiales bacterium
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRKGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVHSICNAIENERKTYGPYFSEDYKFVKTALKEGKTEKELSKKFAAVIKVLKMVSEVVPFIGKELRLSDEAQSKFDNPYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGASDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 161 - protein, 1025 aa, gamma proteobacterium N4-7
MGGYMPQLMRYRLALDIGSTSIGWAMIRLSMQNEPIAIIRMGVRIFSDGRNPKDGSSLAVTRRVARQMRRRRDRLLKRKTRLLNALVQKKFFPEDADARKALVVLNPYELRKEGLYRQLSGPEFGRALFHISQRRGFLSNRKTDKKDNDSSVLKKAIVDLRQQLEVENCQTIGEWLFKQQQSGKSVRARLRGKTQKDKAYDFYIDRAMIAHEFDTLWVSQAKYDPLLFNEDARAILRDILLYQRPLKPVKPGRCTLIPDESRAPLALPLTQQARIYQELNHLRITTPALGAQALTVAQRNTIAALLEKSDVTFVKIAKALGLTSTTEFNLQDIKRDRLKGNATAIILARNQYFGRRWHDFNADLQNLIVDKLVNEGSETALIEWLKANTDVDESAAERVSGVTLPEGYGSLSVAALRRLLPALKEDVVVYSEAVKRAGFDSHSALSLIEQTGELYQELPYYGEVLQRHVGFGSGDPNDSPERRFGKIANPTVHIGLNELRKIINALIKRYGNPAEVVVELARDLKLSREKRKEIQEEQKQRQDRNEKRIKDACEILGIDPLVIDRGKRREISQKMQLWDELNPKDAANRRCPYTGDQISIEKLLSAEVEIEHILPFSKTLDDSLNNKTVAMRRANRDKGNRTPYEAFGESLNPDYDYDAILQRASLMPREKRKRFASDGYQQWLRDDKDFLSRALNDTAYLSRIAKEYLTLICPPNSVRAIPGRMTAQLRAMFGLNRLLSEGGIKNREDHRHHAIDAAVIGVTDQGLLQKFSRASARTRELQLSRLVDDMPLPWDTYREHVTRALEHLVVSHKPDHGYQGKMHEDTAWGLRDNGQVTRRVRSEDGGPRQRLLENKNVVKINSTRDFSRHGIDEQGQVNAYKGYVGGSNYCIEIWIDEKGKWNSDVVSTFQAYQIVRELGEKAAWQKLRNPLLSLSAKPLVMRLIIDDVVKMQIAGQNKIMRVVKIAQNGQIFFAEHNEANVDARDKDKNNPFKYISKTAGSLQKAGGIHMAISPIGDARPVRYGR

SEQ ID NO: 162 - protein, 1364 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDFREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNGENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTGNFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLQPYFVYDNFKKFGNKEDIGHKRFNFLGKIEREKKVVAPETGEILWSNVAPNETIKQIKKVYDYKFMIVSREITTRRAELFNQTVYPKNYHGKLIPIKEDRPTDLYGGYSGNTDAYLAIVALEDKKKGKYFKVVGIPTRVAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 163 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 164 - protein, 1089 aa, Corynebacterium matruchotii
MNSANVNYRVGIDVGSYSLGMAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQAGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 165 - protein, 1134 aa, Streptococcus mitis
MNGLVLGLDIGIASEGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKLRLINVFSTSAYKKEAERILRKQQEFNNQITDEFIEDYLKILTGKRKYYHGPGNEKSRTDYGRFRTDGTTLDNIFGILIGKCTFYPEEYRASKASYTAQEFNLLNDLNNLTVPTETKKLSEEQKKVIVEYAKEAKTLGASTLLKYIAKMIDASVDQIRGYRVDVNNKPEMHTFEVYRKMQSLETISVGELSRNVLDELAHILTLNTEREGMEEAINTKLKDSFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPDNIFHGHKELATKIRLWHQQGEKCLYTGKTIPISDLIYNQYKYEIDHILPLSLSFDDSLSNKVLALATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKTGKLVDFNPFEKYRQENEPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGDKPKLKF

SEQ ID NO: 166 - protein, 1373 aa, Streptococcus bovis
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 167 - protein, 1099 aa, Corynebacterium accolens
MSLLYRVGIDVGTYSLGCTAIEVDDNDQPVSILSSVSLIHDSGLDPDQQKRAVTRLASSGVARRTRRLYRRRRRRMVKLENFLTAQGWETLPFERYSDPYLPWHARVALVNGYISDDTQRGQYLSIAFRHIANHRGWRNPYWKVSSLYSPDKPSDAFEQIRKELEASTGRQIPETATVGQLISFAQFGKDRLRGGGKQKDKKKPQEQVNQAVISARLHQIDHAREINEICRVQKIDDTLRKQILDLVFAAESPKGAQKGRVGKDPLQPKLFRALKASDAFQQYRIAALTGNLRIYRNGVTVPLDRDEKLIVFNYLVNLPKKEEPSWLKIAEILNIDRGQLRGTATMTDDGERAGATPPVHDTNRTILDSKVKPLAHWWENASDDERAAMLKSLSNSEVEDFDSPAGAQVQAFFADLDETEQEKLDSLHLPMGRAAYSEDTLMRLTNRMLDENLDLYEARLAEFGIPKDWAPPAPRIGEPVGNPAVDRVLKGVARWLEAAADEWGAPKSVVIEHVRDGFVSKSKAIEIDRANNNRHKRNRELFQKMQENLGIEGKVRSSDLWRYQSVQRQNCQCAYCGSPITYTTCEMDHIVPRAGEGSTNTRDNLVATCHRCNLAKKNIPFAVWAEKSTIPGVSVKEALDRTRHWSEDSGMSKKDFQKFRKNVCERLNRTVVDEPLDARSMESVAWMANELRGRVAQRFQEENTTVNVYRGALTAEARRAAGITDKLRFIDGTGKSRLDRRHHAVDAAVVAFIHNYVAETLAIRSNKKREAQLLQGTSQWKEFTGSDDKHRAVWNAWIPKMQKLAVLLQIALDEDRIVVTSNLRLRLGNGRAHEDTISELKTIRVGDAISVTDIDRASSEALWCALTREPDFDEKDGLPENPNRRIRVHGTWYDAEDEIEVFPVGAGAIKVRGGYAKLSRFHHARVYKIPGKKAPIYCMLRVYNTDLVQHRHEDLFSVELKPQTMSVRQAEPKLRKALAENTAEYLGWLVTDDELIIDTSTFRTGLIEEMQSEFGLVRRWRLDGFDSPSLLTLRPLHMSAEGLPDDCALGSRKIIDTKGWRVSINKVFNAGNTTVVRRDALGRARLTSNAHLPISWKEE

SEQ ID NO: 168 - protein, 1054 aa, Actinobacillus pleuropneumoniae
MKLTPLNYILGLDLGIASVGWAVVEIDEQENPLGLIDVGVRTFDRAEVAKTGESLALARRLARSSRRLVKRRADRIKKVKRLLKSENILLSADEQLPNDVWQLRVKGLDQKLERQEWAAVLLHLLKHRGYLSQRKNESKSENKELGALRSGVAANHQILQSAEYRTPAEIAVKKFHVEEGHIRNQRGAYTHTFSRLDLLAEIELLFTRQTELGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKHRESAVQKFKEYFPNFVGEPKGKDILKMRLYELQQAKCLYSGKSLELHRLLEKGYVEVDHALPFSRTWDDSFNNKVLVLANENQNKGNLTPYEWLDGKNNSEPWQNFVARVQTSGFSHTKKQRILSHKLDEKGFIERNLNDTRYVVRFLCNFIADNMLLTGKGKRKVFASNGQITALLRGRWGLQKVRDDNDRHHALDAVVVACSTVAMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLNDLERMVNREREMALYESLKVRLEQFDNDPAKAFAEPFYKKGGALVKAVRVEQTQKSGVLVRDGNGVADNASMVRVDVFTKAGKYFLVPIYTWQVAKGILPNKAVTANVDEIDWLEMDESYQFIFTMYPNDLVKVKLKKEEFFGYYGGLDRATGAIVIKEHDLEKSKGRQGIYRIGVKLALSFEKYQVDELGKNIRPCRPTKRQHVR

SEQ ID NO: 169 - protein, 1369 aa, Lactobacillus iners
MNNNYYLGLDLGTNSVGWAVTDDHYNIIKFHGKHMWGMRLFEEAETAKDRRLHRQARRRRQRLVERINLLEELFDKEISKVDQGFFARKKESDLHFEDKTTKSEYALFNDKSYTDRDYYKQYPTIFHLIMDLIENDKKRDIRLVYLACHYLIKHRGHFIFDGKNFTVDNSFENLLDKLITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKILDNQSKYYDFLLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKVDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 170 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 171 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 172 - protein, 994 aa, Streptococcus downei
MENQRGKRQRITHQEPYSIGLDIGTASVGSAVINNDLTVPQKRFKVRDINGNVIKTIKKNMSSVLIFDEANPAKGARTKRTSRRRYTRRNFRLLELKKLFEKEIEKIDPNFFHRIKEDSFFNWNDKEFDKHPLFGNLKEEKKFHNNYPTVFHLRNEIGKNSSKKFDLRLVYLALAHIIKYRGHFLDETFDPDASVSVEKRLNDFIVEYNELFDKDLRSEAKFSEILMSDSSNSVKIESTLSLYPSEKNTIFQVFLKLIVGNQGDFNKFFKDELESSSHSGKLVFSSDEVEDEKEELISIIGEDYLDIINLCQSLYSTVALAKIISTDTGESNTPLSASMVKRYNEHKGDLANLKGIVKHFIPEKYEEVFGEHSKTGYTAYIRNPNKMPEKKFYDYLYHEGEKGKISGILSDSRIYELPAVQKFILKIEQKSFLKKQRTKENGLIPYQLHLKELKIIIENQSEYYPFLHEIEEKLEKLLTFRIPYFVGPLAQTKYINPRFNWLVRKSEDHIKPWNFSEIVDEEKSATKFIEKLISNDQFLFGEKVLPKRSIIYQQFLIFNELTKVSYQIKDGPSRNFDSETKEEIFNSLFKKNKLGCVTVVDLKNYIKNDQCLSEKEDIQIEGIKKKFNSSYSTYADLSEISGLKELLDDDTQLDLVEEIIRILTVFEDKKMRTKQLEKLNLPANVDIEKLCKKHYKGWANVSRQLIDGIADRSRGFKKTILDYLKDDDIPNNDAFSTKVQKSLNRNFAQLITDKSLDFARKLDESYKIDVKKDYPSLVEDIPGSPAIRRAILQSLYTVDEIIGVMGRMPKNIVIEMARTNEVSDSPKTRKERIKKLIKETENDADALNFGISKVSEIFDEVKKDENLFKELEVYLYFLQEGKDMYGTETREGHRQPKEINFYDVKNSTGKYHIDHIIPQSLYSGNPLDNIVLTESTNNKIKDKDVPDEATVYEMKNFWLYLMKKGAISKKKFSFLTKIEQGGLSNEDKFGFINR

SEQ ID NO: 173 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 174 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 175 - protein, 874 aa, Listeria seeligeri
LANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMNDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 176 - protein, 1082 aa, Neisseria lactamica
MAAFKPNPMNYILGLDIGIASVGWAMVEIDKEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFSNPHVSDSLKEGIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEAPTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDNPAKAFAEPFYKYDKAGNRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKNQIDELGKEIRPCRLKKRPPVR

SEQ ID NO: 177 - protein, 1326 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 178 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 179 - protein, 1150 aa, Enterococcus faecalis
MYSIGLDLGVSSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGINDVAKLLGVKKERLSGWRLDKKGKPEIHTLKGYRNWRKIFAESGIDLATLPTETIDCLAKVLTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKNNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQCYDVRFYNFQSANSINFKGLEQEMMPAENQFKQKPYNNGAINLNIAKYGKEGKKLRKFNTDILGKKHYLYYEKEPKNIIK

SEQ ID NO: 180 - protein, 1345 aa, Streptococcus anginosus
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 181 - protein, 849 aa, Listeria ivanovii
  misc_feature (780)..(780): Xaa can be any naturally occurring amino acid
LIDKNGTPQHITMIDKMRGKCTYFPEEVRIAKMSYTAELFGLLNDFNNIYFADPETGEKIGFTEADKKYFIDTFIHDQKGVKNITLKQIMKHKNIINETDIFGYRINTKNGTPIFTEFKGLKALKKALKEVDLPDEFYQNTEMMDEIANILSSEKSFTRREEQLKELFLAAFNDELEEAVKELINDITFKEFHSLSKKAIMVILPELWSTNQNQMQLFVQHKMDKSRLENLQNGTKIQFDDEAILSTIAKRAHRETIKIVDAVRAKYGELDYVIVEMAREKNSDEQKKVYNRAQKKQGDFEKEMCKLLGVSELKELRLNGKQHLALKFWKEQDGKCIYSGKPIALSDIVNNFNGLLEIDHIIPISISYDDSQQNKVLCLRSENQRKGQLSPYQYLIRGMGERSFDAFKAEVLSRHFGKKKQNYLLEMEDIANNDELRKHFINRNLVDTRYAMRTFSNTLKTFYTVNGIPTKVMPVNGAMTSALRKRAKLNKDRDAGHAHHAIDALIVAAIGRLPLIKQLAELRVNEEGEFADKITDKGLDDKTAFDDKTLKFLRNLLNYESKVKYSHKVDRKPNRSLSKQTLYSTREKDGEKYIIGKVKNIYTLDKAGYAALKKRIDKNPEDFLMAQHNPKTWEEIIKIMEVYSKADNPFKEFYDEHGFIMKDGKVPVKSLRYHDKKLGIHVPLTHKYENTRHDVVLLKRNSLRVDIYMNKEGVYKYQGVPYNWFNQKGDKYILDMEKYHNEIDGTRASFKNIDNTFEFQFSLYKNDVFSYMKKDKEGEXVSYTKLFRSDSSPRENRLEVENIDMRTSSQQMPTINPLKNLIKYNTDILGNTYPIQKEKFVTVFTLHSK

SEQ ID NO: 182 - protein, 1457 aa, Prevotella buccae
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGATLKTDKEGYVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQHWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIAEMNQNISKYNDGKPHQPILKVRITEPMGAKYRVGQTGNKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGNECHFIPYYVANVIYNKGGFNMQMHRPQS

SEQ ID NO: 183 - protein, 1330 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 184 - protein, 1123 aa, Mobiluncus curtisii
MFVYLNSPRGFGPATFLTDLPHFCIIFGNNDFMDNRKYHVGIDVGTNSVGFAAVEVGDSGSPIRFLNTMVVIHDSGVDPEQKKYAITRLASAGTARRTRRLYRTRRQRLRELDDFISNELGYPLVNLENFADPYEPWKVRADLATIKLPADELPEAMSIALRHMARHRGWRSPYQRVEALHLHAEISEEFSALKKRVMEKTGDVFSDDATPAEVLVDLMGRQKIRGADGMLSGKLRQSDNANELRKIASVQGIDDETLNRIIDRVFFSRSPKGKASERVGMDALPGQGSKPRALKAMPSFQKFRIVSVICNLRIKDSGDDNRPLSMEEKEQLIGYLMSSTTDDHVTWTDVAELLHVKRSNLQGTAKEGPDGERPYTRPPVNSAWSKIKDSKIKSLVALWKTGDVDVQSAIVEALSNASVLEDARPGADIVVAYLESLDDKELESLDKVGLPAGRASYSEDSLERLTERMLQDDCDLFEARKREFGVSDDWKPPADPIYAPVGNPGVDRVLKIVNRLLMAAEREWGAPTQINIEHVRSGFSSELMQREFERENERRRAQNEEAVKAILTEKGGNSHVSKYDIIRYYAVKRQNCQCLYCGTPITFSDCELDHIVPRKGVGSTNSRVNLAAACRSCNRDKSNLPFAVWAGKTSNFDVSIDGAVSRVKQWQRSQNEGAREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETAREHFAVWKSNMERLTDLFNDKLENDAIPVVQPLRLRLSDSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKIFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILSGQGWRPAINVLFSKGKPRIVRRNSLGIERPSSNNGLPFSWEA

SEQ ID NO: 185 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 186 - protein, 586 aa, Pseudoramibacter alactolyticus
MTYYLGLDMGTGSVGWAATDKNYKLIRAKGKDLWGVRLFQTAKTAAERRSHRVARLRRQREKVRIGYLKTIFSDAINKVDPGFFQRLDDSFFYAEDKNINQPYALFADTGYTDVDYYRDYPTIFHLRSTLIHDTSPKDVRLVYLAVLNMFKHRGHFLASNLSENGVDDFGDIYQQWCKSVPKPVQISDPEAKTEKIENILSKAGISNTRRLEALLEVFGIKRRDAFAEVLKLWCGLKGNLSKIWSETDFSDLDNTKPALSFKDSNLDMVLSQLEEILPDEDYSWLMLTKQIYDWSLLSGMMKDASGKSYDYLSDARVASYQKHSEDLKTLKRFYHDNHLSAAYDQMFRVMGKDNYSAYAGSVQSKKEVVRRGASCGIEELYKRIKKDLKPVPDCETKQIILENIERGTFLPKQLTRDNGVIPNQIHVHELKAILKNAENYLPFLKEGSELTNSEKILQLFQFQIPYYVGPLYSDENNYAWVVRKEGGRVFPWNFAEKVDEKASAEGFISELVARCTYLDNEKVLPKASLLYEKFMVLNELNNLRINGERISVDIKQELYQNLFTRGKKVTLKKSEGLFGGQRIFCL

SEQ ID NO: 187 - protein, 1385 aa, Gemella morbillorum
MKNKTWYLGLGVGPTSIGWAATDSNYKLLRKNKKRLWGVRLFEEAKTAVDRRTFRAERRRLARRKWRISLLEELFAKEVSKNDPNFFLRLKESKYHFEDKSLMNEYILFNDKDYTDKDYYKEYPTIYHLRLSLTTEENPDIRKVYLAVHSMLKNRGHFLLQGQSFNDSNIDSVIKELLELETVKINFEVTDEVIHSLKKIALEKKNLSDKNNDVKKLYPKEKQLQEIFKLVFGGKTSLDKLYDIEEYKELDNSVKSISFKEKVYEEVRPDYEQILSNYIELLDLAKLVYDSIVLADIKKEGKTISESKVELYNKHKDDLANLKKLVKIDSKLSEDKKKEVYFTIFKEDKEKGTNYVNYTHRSQEGKSCSYEDFKKFLKKELEKLEDSPTKTTILEELDLETFLPLQRTKDNSVVPYQIHKEELVKILDNAAKYHSFLAEKDDSGYSTREKVVQLFEFRIPYYIGPLNAHHNTENGGYSWAIRKKGMESVPVTPWNFKDVIDESASAEAFVNNLKNKCAYLSGEDVLPKNSLLYSEYALLNELNALRYEGNRISVEARDVIVTKLFKEQGKKVTKKTIKELLKTEGFIDGKGEIVGIDNIVKNDLKSYRDFKKILADKFDKERVENIILWITLYGESRKLIKEKITKVYGDFYTVDEIEKMSRLTYKDWGILSRKLLTELVSEKLYNEETGECLNIIGAMRQGTILFMELLADKFDYMSQIKNHNKENKDDITEITPDILENLHASPAVKRSIWQTVRIVEELKTIIGCVPTKIFIETTKRNNAPYKVPTLNRNDLVTKYKTIREHEIFELEKELKNTLDFTLNKNRLINEEPSKLKATKLYLYYTQLGRCMYTGKKIDLGELFDNNNKYDIDHIYPQSKVKDGSFNNIVLVTKASNDMKADVFPLKSKFQTKENKIFWRFLKEKKLITEEKYNRLVRTEEFSNGELTGFITRQLVETSQAIKVISNVLRELNPETTICYSKAENVSSFRQSFGKIKEANRKAENNEKLIRVQEINDYYNAKDAYLSIVVGNVYDVKFTRNVHNFIKNNKDARRYSLNGLFYTDVKNANTIAWEMDKTVHVVEKTMNNNNILITRRTSEQKGALYDATLYKAKVAEKAKEGTYYPLKTTDSKIKDVGKYGGFTKIKIAYYSIFEYTLDGKKGKQKITRIVPIPIYISQNIKDDKALLEYAQTRLPGKDLKIKYRKLCIGSLVKINNFNYYIGGKTNNNFTFDSAVQVILDKDSESYIKELAKYLNWKKENKDGKLWESITEDKNIQLYDSLVKKMNTGIFIRKTPNKYTELLTLEVKNKFINIDIDEQVKLLLEILNLLTNKKFTSKLNEIGITASRGVCSFNLSNQSQFSIIEQSVTGVYEKEKLIIEKKKEGIL

SEQ ID NO: 188 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 189 - protein, 1422 aa, Sutterella wadsworthensis
MTQSERRFSCSIGIDMGAKYTGVFYALFDREELPTNLNSKAMTLVMPETGPRYVQAQRTAVRHRLRGQKRYTLARKLAFLVVDDMIKKQEKRLTDEEWKRGREALSGLLKRRGYSRPNADGEDLTPLENVRADVFAAHPAFSTYFSEVRSLAEQWEEFTANISNVEKFLGDPNIPADKEFIEFAVAEGLIDKTEKKAYQSALSTLRANANVLTGLRQMGHKPRSEYFKAIEADLKKDSRLAKINEAFGGAERLARLLGNLSNLQLRAERWYFNAPDIMKDRGWEPDRFKKTLVRAFKFFHPAKDQNKQHLELIKQIENSEDIIETLCTLDPNRTIPPYEDQNNRRPPLDQTLLLSPEKLTRQYGEIWKTWSARLTSAEPTLAPAAEILERSTDRKSRVAVNGHEPLPTLAYQLSYALQRAFDRSKALDPYALRALAAGSKSNKLTSARTALENCIGGQNVKTFLDCARRYYREADDAKVGLWFDNADGLLERSDLHPPMKKKILPLLVANILQTDETTGQKFLDEIWRKQIKGRETVASRCARIETVRKSFGGGFNIAYNTAQYREVNKLPRNAQDKELLTIRDRVAETADFIAANLGLSDEQKRKFANPFSLAQFYTLIETEVSGFSATTLAVHLENAWRMTIKDAVINGETVRAAQCSRLPAETARPFDGLVRRLVDRQAWEIAKRVSTDIQSKVDFSNGIVDVSIFVEENKFEFSASVADLKKNKRVKDKMLSEAEKLETRWLIKNERIKKASRGTCPYTGDRLAEGGEIDHILPRSLIKDARGIVFNAEPNLIYASSRGNQLKKNQRYSLSDLKANYRNEIFKTSNIAAITAEIEDVVTKLQQTHRLKFFDLLNEHEQDCVRHALFLDDGSEARDAVLELLATQRRTRVNGTQIWMIKNLANKIREELQNWCKTTNNRLHFQAAATNVSDAKNLRLKLAQNQPDFEKPDIQPIASHSIDALCSFAVGSADAERDQNGFDYLDGKTVLGLYPQSCEVIHLQAKPQEEKSHFDSVAIFKEGIYAEQFLPIFTLNEKIWIGYETLNAKGERCGAIEVSGKQPKELLEMLAPFFNKPVGDLSAHATYRILKKPAYEFLAKAALQPLSAEEKRLAALLDALRYCTSRKSLMSLFMAANGKSLKKREDVLKPKLFQLKVELKGEKSFKLNGSLTLPVKQDWLRICDSPELADAFGKPCSADELTSKLARIWKRPVMRDLAHAPVRREFSLPAIDNPSGGFRIRRTNLFGNELYQVHAINAKKYRGFASAGSNVDWSKGILFNELQHENLTECGGRFITSADVTPMSEWRKVVAEDNLSIWIAPGTEGRRYVRVETTFIQASHWFEQSVENWAITSPLSLPASFKVDKPAEFQKAVGTELSELLGQPRSEIFIENVGNAKHIRFWYIVVSSNKKMNESYNNVSKS

SEQ ID NO: 190 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 191 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 192 - protein, 738 aa, Treponema phagedenis
MLQELFAKEIAKIDEGFFRRLDESAFYLEDKSLKQKYSLFNDDNFTDKDYYKKFPTIHHLIKALINDETHVDIRLLYLACHTIIKNRGHFLFEGKEFNTESRFDDAINELFSYLRQDMEIDFAFEDKIADIKEILENKKIGMRDKQNALNKKLSIAPKDKQKKEIIKLIVGASFNLKTLFNDEKYSSEKESYSFAKSNYEEKEAVLESLLGDGFGLILRAKAVYDSSVLSEILGNETYLSFAKVKIYDKHKEDLAKLKKVIKTYHADEFKKVFAEANIQGNYCSYVGSCKKNGKKVPIEKRADKDAFYDFLKKILKDEKAKNSDADYAFILNEIELKTFLPKQVSKKNANIPYQLRRMELEKIVNNAEKYFSFLSEKDEYGTVKEKIIQLLTFKRPYYIGIIQDTHKEKFPDRCWVVKKENAKNEKITPWNFYDHIDEDKTAEAFITSRTNKCTYLIGEDVLPRNSLLYMEYTVLNELNNLKVSVDGVNIFDVKLKKKIYEQVFKQRKEVSKKTIADFLKKEGICKKENDVVITGIDEKCTTSLKLYIDIKKIIGKRIEEEPTKNALEDIILWASIYDEGEGRKILEAKIQSVYPDVFTQDELNKILKLKISGWGRFSRKFLESIVASFPGFTDTINIITAMRETNFNLMELLGDAYGFSKGIEKFNSKFNDDKKVFSYDKLVKDLYLSPSVKRMLWRALVIVKEVKSIMGKDPKKYLLKWQEEKKLKREGLPPAMQV

SEQ ID NO: 193 - protein, 1377 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 194 - protein, 1128 aa, Streptococcus vestibularis
MSDLVLGLDIGIGSVGVGILNKVTGEIIHKNSRIFPAAQAENNVERRTNRQGRRLTRRKKHRRVRLNHLFEESGLITDFTKVSINLNPYQLRVKGLIDELSNEELFIALKNMVKHRGISYLDDASDDGNSSVGDYAQIVKENSKQLETKTPGQIQLERYQKYGQLRGDFTVEEDGKKHRLINVFPTSAYRSEALRILQTQKEFNPQITDEFINRYLEILTGKRKYYHGPGNEKSRTDYGRYTTKKDSENEYITLDNIFGILIGKCTFYPEEYRAAKASYTAQEFNLLNDLNNLTVPTETKKLSEEQKNQIINYVKNEKAMGPAKLFKYIAKLLSCDVADIKGYRIDKSDKAEIHTFEAYRKMKTLETIDFEKMSRDQLDKLAYVLTLNTEREGIQEALDHEFADGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGRAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKSLSNKKKEYLLTEEDISRFDVRKKFIERNLVDTRYASRVVLNALQEHFRAHKTDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRQAKVGKDKKDETYVLGKIKDIYSQTGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKDSNNKVVLQSVSPWRADVYFNKTTGKYEILGLKYADLQFEKGTGTYKISQEKYNVIKKKEGVDSDSEFKFTLYKNDLLLIKDTETKEQQLFRFLSRTKPNVKHYVELKPYDKQKFEGNESLINVLGAVAKGGQCQKGINKPNISIYKVRTDVLGNQHIIKNEGDKPKLDF

SEQ ID NO: 195 - protein, 1080 aa, Unknown
  Methylocystis sp. ATCC 49242
MRVLGLDGGIASIGWALIEIFEDHEPSDGRIIDTGAWMFDAPEEKSQTGTKLKSELRRIFRGQRRVIRRRRQRMNEVRRILHRHGLLSSDNRDALKQPGLDPWKIRAEGIDRLLSPIEFAVALGHIARHRGFKSNSKGAKTSDLDAESSRMKKAVGETREKLARFGSPAKLLVEDEGFVLRQTKLKSGALETVRRFRNRDGDYSRSLLRDDLAAEVRALFRAQARLQSTFAKVELEAEFTQAAFFQRPLQDSERLVGPCPFEPAEKRSPKRGYSFELFRFLSRLNHLTLREGSEERTLTVEELRTAAADFGGVAKFTFSTLRKRLALPDIAIFVGIKADDEKKLDVVARSGEAATGTARLRRVVIDALGELAWGALISAPERLDKITEIITFRSDLDRIRAGLIEAGFDTPLIEAIVRAAADGKLDAFTGVGHISAKAARNIIPGLMRGMTYDKACAAAGYDHTASRERDAFDVGMHGKEALKKILQEERISRELVGSPSARKALIEAVKQVKAIIEKYGVPDRIHVELARDVGKSIEERRDIHFGIEKRSRQKDKLRELFGKEVGHLPQDGERGKEELLRFELWNEQMGRCLYTDEYINPKQLVASDNSVQVDHILPWSRFGDDSYLNKTLCTAKANQDKKGRTPYEWFRADKPEAEWDAFVARVESIQFMKGLKKRNYKLKNAEEAAEKFRSRNLNDTRWTCRLLAEALKQLYPKGEKDKDGKERRRVFTRPGALTNRLRRAWSLQRRKKSEKGERIADDRHHALDAIIVAATTESLLIRATREVQDIERKGLHYDLTKNITQPWPGFADEALDAVEKVFVARAERRRARGKAHDATIRHIAVRDDEAKVYERKKVGDIKLGDLIRVKDAERNAPLIENLRKWIEAGSPRDNPPLSPKGDPVSKVRLVTKNKVNITLDTGNPERLATVDRGEMARVDVFRKANRKGKYEYYLVPIYPHEIATMETPPMRAVQGGGDDDKWPEIDSTFEFLWSINQLSLLELTKPDGEVIRSYFRSLDRNTGALTVSGIANSTATRKGIGTRTLIDFKKLHVDRLGQIFEVERELRTWRGETWRGKDCI

SEQ ID NO: 196 - protein, 1087 aa, Phascolarctobacterium succinatutens
MLRMKYAIGLDIGIASVGYAVLALDHEENPWGIIRLGSRIFDVAENPKDGASLALPRREARSVRRRLRRHHHRLERIKNLLINTEFITKDELLHLYDGNLSDVYELRVKALDYSVTNAELTRILLHLAQRRGFKSNRKSDANDKEAGQLLEAVSANAKRMQENHYRTVGEMFYKDDLFSKYKRNKGGTYLTTVHRDMIAAEARTILEKQFALGNNICTQDFIDKYLSILLSQRQFDEGPGEPSPYAGNQIANMIGKCTFEPNEYRAAKASYSFERFNLLQKVNHLRLLLEGKSIALDNEQRKKIIALAHDKADLRYSHIRKALGLDEKVLFNTITYNDDVSVIEKKTKFNFLQAYHQIKKVLAEDMQKLTTEQLDNIGQILSTYKSDNKRTEELSALGLEKKIIDALLGINGLSKFAHLSLKALRKINPYLEEGKIYNEACTAAGYDFKAHANTQKTELLPAYKEEMDDITSPVARRAIAQSIKVINAIIREQKGSPLYINIELAREMAKGFDERTQIDKANKENQAKNERIMERIRTEFHKANPTGMDLIKLKLWEEQDGRSPYSQKAISINRLFEPGYVDIDHIVPYSISFDDSFKNKVLVFSDENRDKGNRLPIAYLQSKFGAKAAENFMIWVQSNIKDYKKRQKLLKREITEEDINKFKERNLQDTKTISRFLYNYINDYLLFAPSDTGKKKRVTAVNGTITAYLRKRWGINKIRANGDKHHAVDAVVIACTTDKMIKDLSSFSRYHELEYTHTDTESFLVNSLTGEILKRFPYPWEDFRPELMARLSDNPADALRKLNLIFYHGIDLSTIKPIFVSRMPRHKVTGAAHKATIKSARCLDNGIVICKTSLQNLKLDKEGEIANYYAPESDTILYNALKERLRSYDNKPAKAFAEPFYKPKADGTPGPLVKKVKVYEKSTLNVAVQQNTAVADNDSMVRVDVFHVKGNGYYLVPIYIADTLKKELPNKAIVAYKPYADWPVMDDSNFIFSLYPNDLIKFEHKNSVKFAKVNKESTLNDFYSTKSEIVYFKGCNINTGAITIINHENTYVVSSLGVKTLPSLEKYQADVLGNYTKVKKEVRKPFR

SEQ ID NO: 197 - protein, 1375 aa, Lactobacillus ruminis
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 198 - protein, 1391 aa, Prevotella oralis
MKKILGLDLGTTSIGWALVNEKENNEELSSIIRLGVRVNPLTVDEKSNFEKGKDITTNADRTKCRSARRNLQRFKLRREALADCLKRHGLMTDETPLCETNNSIIFKTYSNRAKAVCEKIALDDFVRVLFMINKKRGYKSSRKLNTDDEGTLVDGMDVAKLLYNEQITPGEYLLRLFKKGKKTRPDFYLSDLKAELERIWDFQRTFYPEILCNALKEDLKGKSRTQSSAIFYAKYKVSTAKIAGKDKRLQELTWRTDALRKQLTIDEVAYVICSINGEVNGSSQRLSMISDRSKLLYFNHQTIGQYLMQRLEENPNAGLKNIIFYRQDYEDEFNDIWNSQATYHKELTPELKKEVKDIIFYQRGLKSCKWLINYCELEHEEIEVKTPEGKLRKITIGSKTCPKSSPLFQEFKIWQVLNNLQVSPLNSRRKAKRKKDEEPSLFSDEDMNTACRYLNEEEKLTLFKELSIKKELKKKDALKLLFENYKELDLNYKVISGNVTMANLYRAFQDIISLTGNGEFDFQAMPAEEAEKTVEEIFGGLGYKTAFLHFDASLHDKEFERQPAYRLWHLLYSYAGDQSKTGIEALVKRIQELCGFEPEYARILANISFIPDYGNLSSKAMRKILPYMQDGYEYSEACSKAGYRHSASSLTKEEINKKNYKTHLDEIKRNSLRNPIVEKILNQMVNVVNSVIDTYSNIDEIRIEMARELKKSKPEREDMSFAISKATKETERIKGILEQEFKIQHVTRNDIIRYRLYEELKPNGYKTLYSNTYIPREDLFSKKFDIEHIIPKARLFDDSYSNKTLELRDINIEKGNQTAYDFVLSKYGEEGLYKYEQRVEEFKKNNEQAGTKCRKLLMREADIPSDFLNRDLNDSQYIAKKAHELLREIVPTVTATTGSITNRLREDWKLVNVMKELNWEKYDKLGLTEEYKDKDGNTVRHIKDWTKRNDHRHHAMDALTIAFTKPSFIQYLNNLNARSNRGGSIYGIEQKELERENNKLVFIPPIDPKIFRKQAKEHLSNILISIKAKNKVVTKNVNKTKSKSGTNRKVQLTPRGQLHLETVYGKIRTYKTEEIKVGTKLTEELIAKVADKKIREALMQRLSEYGGNIKKAFQNISKHPIWLNGSHTKHVPEKVKIVFFEDVFTIRKAITPDIKIDKVIDSKIRRILQERLNEFGGEASKAFSNLDENPIWFNRDKGIAIKSVKIRGIAKGTAIRVKKDIHGKTIIGNNGYPVANDYVNTGNNHHVAIFRDKDGNLQEHIVSFYEATARAIQNLPIVDRNYNSEKDWKFLFSMKQNEYFVFPNPNTGFNPSEISLKDEKNYALISPNLFRVQKLSHYYYVFRHHLETNVDTNLQLKDITWKRITAVNNLTGAVKVRIDHLGRIVDVGEYK

SEQ ID NO: 199 - protein, 1167 aa, Streptococcus sanguinis
MLFGLKTKFKDCFELEEEPDLNFSKENYDDNLEKLLGELGEDFSDVFDKLKILRDTILLSGMLTYTGATHARFSATMVERYEEHRKDLQRFKSFIKQNLSEQDYLDIFGRKTQNGFDVDKETKGYVGYITNKMVLTNPQKQKTIQQNFYDYISGKITGIEGSEYFLNKISDRTFLRKLRTSDNGAIPNQIHAYELEKIIERQGKDYPFLLENKDKLLSILTFKIPYYVGPLAKGNNSRFAWIKRANSSDILDDNDEDTRNGKIRPWNYHKLINMDETRDAFITNLIGNDTILLNEKVLPKRSLIYEEVMLQNELTRVKYKDKYGKAHFFDSEHRQNIINGLFKINSKRVNAERLIKYLSDNHKDLNAIEIVSGVEKGKSFNSTLKTYNDFKTIFSEEFLDSEIYQKELEEIIKVITVFDDKKSIKNYLTKYFGHLEFLDEEKINQLSKLRYTGWGRYSAKLLLDIRDEDTGFNLLQFLRNDEENRNLTNLISDNTLSFDPKIKAIQSKSTVEDDVFDEIKKLAGSPAIKRGILNSIKIVDELVQIIGYPPQNIVIEMARENMTTEEGQKKTKTRKSKLESALKNIENSVLENGKVLHSDEQLQSEKLYLYYLQNGKDIYSLDETGSPAPIYLDQLDQYEVDHIIPYSFLPIDSIDNKVLTHRKNNQRKLDNIPDKETVAHMKPFWEALYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHVHFNRHEENKATLRKHLYSNIMRFFNNPDSKVSKDIWDCNRDLPIIKHVIYNSQINFVKRTMIKKGAFYNQNPVGKFNKQLAANNRYPLKTKALCLDTSIYGGYGPMNSTLSIIIIAERFNEKKGKIETVKEFHDIFIIDYEKFNNNPFQFLNDTSENGFLKKNNINRVLGFYRIPKYSLMQKIDGTRMLFESKLNLHKATQFKLTKTQNELFFHMKRLLTNSNLMDLKSESAIKESQNFILKHKEEFDNISNQLSAFSQKMLGNTTSLKNLIKGYNERKIKEIDIREETIKYFYDNFIKMFSFVKSGAPKDINDFFDNKYTVARMRPKPDKRLLNATLIHQSITGLYETRIDLSKLGED

SEQ ID NO: 200 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 201 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 202 - protein, 1440 aa, Weeksella virosa
MKTILGLDLGTNSIGWALVEQDFENKQGLILGMGSRIIPMDAGIIGKFAEGSSISQTAERTGYRSIRRLRERHLLRRERLHRVLNILKFLPEHYAAEIDFEKRFGQFLAETEPKLAWKKNAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRRNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWDIIDDKTKTRIGKIITGEYDETIKNRVREKAIDLTEENHFQGLQLWLAQYIVYDRHSEADIAGKWNSVADLEQYLSEFKQHSLRNPIVEQVITETLRVVRDIWKQYGKGAKDYFDEIHIELGREMKNTAEERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMNDTRYISKYISKVLSNLVRGEKDDEGVNSKNIIPGNGKITGILKQDWGLNDVWNDLILPRFERMNQLTNSTDFTAWNEKHQKFLPSVPLELSKGFQKKRIDHRHHALDALIIACATRDHVNLLNNKHAKSRNERYDLQHKLRHTTPWQDKEGKVRTKFTEFKKPWETFTQDTKKELEKIVVNFKQNLRVINKATNYYEKIVDGKKVMFKQEGVNWAIRKPMHKETVSGKIDLPRVKVSKGKILTATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYEDNQGKRSYDTIPLNIVIERQKQGLNSVPETNEKGHRLLFSLSPNDLVYVPIEGEVFDETNPDVNRIYKVVSFSGSQMFCVRQDVATSIVYKLEFSSLNKMERTIDGIMIKEICIKLKVDRLGNISKA

SEQ ID NO: 203 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 204 - protein, 1370 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 205 - protein, 1044 aa, Unknown
  Nitrosomonas sp. AL212
MLHKMRYRLALDLGSTSLGWAMVRLNANQQPCAVIKAGVRIFSNGRNPKDGSSLAVTRREARSMRRRRDRLLKRKARMMRTLIEYGFFPANETQRKALENLNPYALRAKGLDEALTPSEFARALFHINQRRGFKSNRKTDKKDSDSGALKTAIKQLHSVLDPQGNDGKPRTVGELLYKRFTDLSKLPKDRTVRARYRQDKIVKDDGKTKIDKYYDLYIDRAMIEQEFDALWKKQSELNPILFTENARADLKDVLLYQRSLKPVKPGRCTFMSEEERAPLALPSTQRFRMYQEVNNLRILREGLKEESLTLQQRDDLINALEKNNRRTFTQIKKLLGVGGSVQFNFEDPKREELKGNTTSAILGKSEHFGEAWFAFNEAKQDAIVLQLIKEENEAKLVRWLQDETGIDEKRAEVIANAGLPEGYGSLCIEALARILPELRRDVVTYDKAVQAAGFEHHSKLNRNEEIPDITFKIESIDRNSGEIKQFHLHKELPYYGEYLQRHVGFGSGKPEDSIEKRYGKIANPTVHIGLNQVRVVVNALIKRYGHPSEIIVEVARDLKQSKDRRDEENKRQAENQKRNERLRKDIADILGISEERVRRDDIEKMILWEELSFDPADRRCPYSGVQVSTVMLLSDEVEVEHILPFSQTLDDSLNNKTVALRQANRIKGNRTPWEAFGTSNISGFDYSGILTRAELMPKAKRYRFAEDGYQRWLKDDAGFLARALNDTRHLSKIAREYMSLICPNTRVIPGQMTAMLRRNFGLNDVLGLNGEKNRNDHRHHAVDACVIAVTDQGLLQRFAAASASARERQLNRLVENMPLPWESYREHVRRAIDGIWVSHRPDHSHEGAMHNDTAYGLRGNGRVSFHKMVEGKREYIEDNLKVIEITDTKAIDRHGLLPTGKPRPYKGYKGDSNYCIEIVRNEKGRWEGEIISTFDAYQLVRKYGIVQLRYPVLSVSGKPLVMRLIRNDFVRLEHEGITRTLRVCKMREDGQVALADVTEANVDARTRTKEICYVFKTGGSLQKAKARRITISPIGELRDPGFKE

SEQ ID NO: 206 - protein, 1045 aa, Acidovorax avenae
MQKEKPLAYRLALDLGSTSLGWAVLRLSAPGEPSAVIRAGSRIFSDGRNPKDGSSLAVTRRAARAMRRRRDRLLKRKARMLAALERHGFFPQDEAARKALEKLNPYGLRARGLESALKPEEFGRALFHLNQRRGFQSNRKTDRKDSDSGALKQAIGTLRAQMHESGCRTVGEWFWKVRMERKPEGVKGQGVRARYRETPFTTDEGKKRIDKRYDLYVDRAMVAQEFDALWAAQATFAPALFNEAARAELRDILLHQRKLRPVQPGRCTLVPEEPRALLALPSTQRFRIYQEVNHLRVLHDELREEALTLAQRDQIVALLERQAKVTFTAMRKALGFSALFNLEDAKRDGLKGNATTAALGKKDLFGPLWAGFDTALQDEIVTQLMTEESEPRLIAWLQEHTGVDEARAQAIANAGLPEGYGSLGRTALARIVPELQRDVITYDKAVQAAGFAHHSDLGFSFEHDADEVERIGERTIASTGEIKPVFAFKQLPYYGRALQRHVAFAKENPRNDEERYGKIANPTVHIGLNQVRVVVNALMCRYGRPTEVVIELARDLKQSREQKLEAQQRQADNQKRNARIRRSIAEVLGISEERVRTLDIQKWILWEELSHDAADRRCPYSGVQISASMLLGERVEIEHILPFSMTLDDSLNNRTVALREANRIKRNRTPWDARTDFEAHGWSYDGILQRAERMPQRKRHRFAPDGYERWLGEDKDFLARALNDTRYLSRVAAEYLRLVCPGSATRVIPGQMTALLRGKFGLNDVLGLDGEKNRNDHRHHAVDACVIGVTDQRMMQRFAQANAQAREDGLTRLVEDMPLPWPTYRAHVERAVRHIWVSHKPDHGFEGAMMEETSYGILRDGTIKQRRKADGSAGREISRLIRITEPSQPQRHGVDAEGRPLPYKGYVGGSNYCLEITVNDKGKWEGQVISTFDAYRIVREGGLRQLRHSTQGQNGQALAMRLVIGDSVRLEVDEQERVMRIVKINGNNGQVFMAPVHEANVDARNSDKNEAFAYTSKIAGSFQKTKARQVTISPIGELRDPGFKG

SEQ ID NO: 207 - protein, 1218 aa, Prevotella denticola
MKASEEKLSKGLSTYMKENNLLTVGAAFAQLEDEGVRIRNNNNYRAIRSQFQHEIETIFMFQQGLSENELYERLVSEKKNIGTIFYKRPLRSQRGNVGKCTLERTKPRCAIGHPLFEKFRAWTLINNIKIRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGEQWKKLYHPSQIAIYRPVSAGKDRSALRLGNPDIGAIKNPTVLRVLNTLRKRVNQLLDDGLISPDETRVVVETARELNDANRKWALDNYNRIRHDENEKIKKILEEFYPKRDGISTDDIDKARYVIDQREMDYFTEEKPYNKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQFAKDKDGKVLLKEGHPLVDPTIKFVIRRELKYKKSTADSGFASWDDLEKAIVDKELFALMKGQFPEETSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 208 - protein, 1458 aa, Fluviicola taffensis
MTKTILGLDLGTNSIGWALINQDFDNKKGEILGMGSRIIPMTQDIKDEFGKGNSISQTAERTRLRGVRRLIHRTLLRRERLHRVLNIIGFLPEHYANQIDFEKRFGKFKPESEPKISFDGNDVFLFEKSYQEMLVDFKIHQPQLVSNGKKIPHDWTIYYLRKKALSKKIEKEELAWILLNFNQKRGYYQLRGEEEEETPNKLVEFHSLKIVEVNADEPQKGKPEIWYSLVLENGWVYRRASKTPLFDWKDKIREFIVTTEINNDGTVKTDKEGTEKRSFRAPKPEDWTLQKKKTEFELSKSGNEVGAFIYESILQKPNQKIRGKLISTIERKFYKEELKTILKTQLFFHKELKDEKLYNACIEELYKNNEAHRSLLSNKGFEHLFINDILFYQRPLRSKKSQISNCPLEKRTYKKEGIEITEGIKVISKSNPIYQEFRLWQWISNLSLYCIEPTETNVTSTFLNSIEDYENLFEFLNNRKEIEQKHLLKYLLENQGFKGKLLTNELEKFRWNFVADKKYPCNETGSLLHTRLSKVKNISPDFLTKEIEHQLWHIIYSVTDKIEYEQALKTFARKNNLDVDSFFEHFKKIPPFESTYGAYSEKAIKKLLPLIRLGKYWNWEAIDSISKDRISKILSGEYDENIKNRVREKAVHLTSENNFQGLQEWLAKYIVYDRHSEGNDLGKWTSVSDLETYLKEFKQHSLRNPIVEQVITETLRVVKDIWIKHGKGTENFFDEIHVELGREMKNNSEDRKRLTNTITENENTNLRIKALLMEMMNDNDVENVRPYSPSQQEILKIYEDGALNSNIELDDEIVKISKKAEPTKSELQRYKLWLEQKYRSPYTGQVIPLNKLFTSEYEIEHVVPQSRFFDDSFSNKVICESAVNKRKDNQLGLQFIKNHSGEKVELGFGKVVQVFTEEQYLDFVKEHYSKNRSKHNKLLLEEIPEKMIERQLNDTRYISKFVSSILSNIVRSEKDDDGLNSKNILPGNGKITTELKRDWGLNDVWNDLILPRFERMNTITNSDLFTTYNDKYQKHLPTVPFEYSKGFQKKRIDHRHHAMDALVIACATRDHLNLMNNQSAKSELKRYDLQNKLRKKEPYFNQKENKQKEAFKDFIKPWGTFTEDSKNALEKIIISFKQNLRVINKATNSYESYKDEDGNLRIGKDGKPEKGLIKQKGLNWAIRKPLHKDTVSGQINLSRIKLPNGKILTATRKNLDTSFDLKTIENSITDTGIQKILKNYLLSKESPELAFSPEGLEEMNNEIEKYNNGKFHHPINKARIYELGSKFNVGQTGNRRDKFVEAAKGTNLFFAIYQDENKNRSYETIPLNEVIEHQKWRASLPKEEQEKIPLVPVNKLKGTFIFSLSPNDLVYVPSNDELERSASIDFSKLKKEQINRLYKMVSSSGSQCFFVKSEVATSVVNKMEYSSLNKMEKSIDNLMVKEICIKLKIDRLGNISKA

SEQ ID NO: 209 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 210 - protein, 1077 aa, Neisseria bacilliformis
MQQKPQRYILGLDLGIASVGWACVWADENEHPTGLLDCGVRTFERAEVPKTGDSLALARRQARSVRRLIRRRAHRLLRLRRLLKREGVLLSADFNENGLVRGLPIDAWALRVAGLDRKLSNKEWAAVLLHLVKHRGYLSQRKNETQSKDKELGRLLAGVNGNREALQNRSDEYRTAAELAVKKFAAENNGSLRNKGGDYSHTFDRKDLQRELHLLFERQRALDNPFTSSEMEAAVDELLMKQRSALQGEAVLKMLGRCTFEPSEYKAAKNTYSAERFVWLTKLNNLRIQYNGEERALSEAERRLLLDEPYQKAKLTYKQVRTILELPESAVFKGLRYGHGEDGLKAESGTLMEMKAYHAVRKALKDAGLEGEWENRIRNPELLDAIGTAFSLYKTDEDIRANLAAFRLSENVLEALLAGLNFDKFVHLSLKALAKILPLMEQGMRYDEACKEAYGDHYGAKEQEDHRLLPPFVADDIRNPVVFRTLTQARKIVNEIVRRYGSPLRVHIETGREVGKSFSDRKEIEKRQEENRKERERAAAHFKELFPNFAGEPKAQDILKLRLYEQQHGKCLYSGKEIDLRRLPEKGYVEIDHALPFSRTWDDSFNNKVLVLGKENQDKRNRTPYEYLDGKGNSGAWRAFAERVSGCRFPYAKKQRLLTQKLDEKTEQGFLERNLNDTRYVARFLCQFIEEKMHLEGAGKKRVFASNGQITALLRGFWGLKKVREENDRHHALDAVVVACSSVSMQQKITRHFRYREELEHIDRETGEVIHGFPQPWEFFRQEVMTRVFSDDPVSELAEKLDSRPEAVHEFVTPLFVSRAPHRKVTGQGHLETIRSAKRLDEKISVVKLPLTQLKTKDIERIVGYPNREPALYDALAARLAAFKDDPAKAFSEPFYKTGKDGKCGVLVKAVRVENVQKSGLLVRKDESGKMQGVADNATMVRVDVFGKNGKNYLVPVYAWQVEKGELPNRAVVAYADEEDWDEMDDSFEFKFSLYPNDLVEVVTKKDKFFGYYSGFNRATGAINIKEHDLSKSKVKNGVYEGIGVKTAQSFQKYQVDTLGKTIRLCKPEKRMGFKKK

SEQ ID NO: 211 - protein, 1029 aa, Alicycliphilus denitrificans; identical to SEQ ID NO: 188

SEQ ID NO: 212 - protein, 1122 aa, Streptococcus suis; identical to SEQ ID NO: 82

SEQ ID NO: 213 - protein, 1428 aa, Parasutterella excrementihominis
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRRGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVRSICNAIENERKTYGPYFSEDYKFVKTALKEGKTEKELSKKFAAVIKVLKMVSEVVPFIGKELRLSDEAQSKFDNLYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGTSDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 214 - protein, 1371 aa, Lactobacillus buchneri
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDNTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADCDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 215 - protein, 1090 aa, Unknown
  Sphingomonas sp. S17
MDWRLGLDLGANSLGWAALRLDRAGDPIGILAMGSRIFSDGRDPKSGASLAVDRRAARAMRRRRDRFKQRQAALLKYLIRDGLFPADQADRQRLADEDPYALRARALDEELSLFEIGRALFHLNQRRGFQSNRKADRGQDDEAGKIAVGVDRLNQQMEEQGARTLGEFLHQRRRAATDANHIPSVRTRLRPETGEGAKGDGYDFYPSRALIAEEFEEIWAAQAPHYPDTLTQQVHDRLYEIIFHQRPLRAPQVGQCTLVAGETRLPKAHPLFQKRRLLEEINALMIVRPGEIAQRLTPEERDTLYLKLKDKRTVSFATLRKTLKLDSAARFNKESENRTELKGDEVAAELGAKTRLGTRWQHLSGDQQWEVVHRLMALESQADEAAFRDWISQTYDLLPEQAAAVLGARLPQGHGRFGPTATTTLIDSLLHDRTEDGRVVVYSEAVQRSGLGHHSDLRHDRDDEDVTELPYYGVALERHIMPGTAEPTDPEEMRIGRLTNPTVHIGLNQLRHVVNRLIRAYGPPKEIAIELARELKLSEDEKKKRNSENRDNRLAAEGRSKKLEEIRQRDTGANRALLKLWEELNPGNVLDRRCIYTGEQISIDMLFSDRVEVDHILPFAQTLDDSNGNKLLCLREANREKRRRSPYEAWGHTDRWPDIAERASRLPKPKRWRFEPDAMQRFATEDGFLARHLVDTQYLGRLAREYLSWLYPGRGEGSGHVWVSPGRLTEMVRRKLGLNDLLPDHNFGGGADQPKNRLDHRHHAIDALVVAIVDRGMLQAIARASGQDGSEGRERIHIPAPWDGFRDDLRVAVNGIIVSHRPDHGTVAKAGLARGRDQTAGRLHNDTAYGLTGETDAKGNSIVVRRIPLSAIKKPADIARVRDPLLRNALAEFTKGLDGKAFEARIGRFHELGPLLYRGIRRVRVVETLTVIPIRDAEGRAYKGYKGDSNYRYDVWEMPDGKWRCQVVSMFDAHQSTEQARPHPAARKILSLQRNDILAIERTEGDRELVRVVKFSEKQFAVAPPHEGGSLKTRDGNADDPFRYLYPSPNTLKGWRARQVRIDELGRVLDPGFPARKSVRRTRPRAAPVD

SEQ ID NO: 216 - protein, 1000 aa, Kingella kingae
MARAQRRLISRRANRMNKLRRLLKQENVLQANDYDEKGLIIGLPNQAWELRAQGLDRKLEPKEWAAVLINLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQEQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 217 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 218 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 219 - protein, 1126 aa, Lactobacillus farciminis
MADRISLGLDIGVASVGFSVLDIDKGKVIELGARLFSATVAAGNQDRRDMRGARRLLNRNKQRRQDTGKLFKKFGLIDDFDKGSFYDNFNQNLNPYELRVKGLTEQLTKEELAESLYQIVKHRGISYALKDADVDEGGTDYSVSLKINSQELAEKTPAQIQLQRLNDYGKVRGQVVIGDDPDNQKVLLNVFPTSAYEKEAKQIIATQQQFYPESLTDKFTEEYCQILTRKRDYFVGPGNEKSRTDYGIYKTDGRTLDNLFEELIGHDKIYPEELRASAASYTAQLFNVLNDLNNLRILNYEDGKLTKEDKEKIIAEIKNNTTTINMLNVIKKVAGCSKDDIKGFRVNEKDKPEISSMPVYRKIHKDLLKAGVDISDWPVEFIDELSFILTLNTENGEIRKQLNNRLAPKFDFLNADLIQLIIDNKDSFEIKTNNKWHRFSVKTMNKLIPEMMERPVEQMTLLNEMGLVKKDKKRFENNKYLPYKEIAKDIFNPVASKSVREALKIVNAVLKKYGHIDYLVVEMPRDKNLKEEQDNIKEFQNKNKKAKDAAFEAFVKSVGSEQRVKEALSKNRKLQMKMRLWYQQQEIDPYNGKTIDATDLINNPDKFEIDHIIPQSISFYDSINNKTLCFASMNQVKGQKTPYEFMLEGHGQSYDKFKATVMANKNFGKAKRANYLFEENVSDIETRKRFLSRNLVDTRYSSRVVLNSLQDFFREKSADTKVTVIRGKFTSNMRKHWHIDKTRETFHHHAIDASIIAATPFLRMWKKGGTIFPVKVGEESIDIETGEILDDKNFDKAMYEEPYSGFVSEIMNADDRIKFSHQVDKKMNRKVSDATIYSTRTGKLAKDKKDAEYIVAKVKDIYSVDGFKKFKKVYDKDKTKFLLYKYDPRTFSKLERIISDCPDKVEKVQTNGKVKAVDISPFEMYRRDHGMIKKYSKKGNGPAIKQLKYLDKKLGSHIDITPANANGKHVILQSLKPWRTDVYLNHETGEYEIMGIKYSDLKFNKNEGYGIKKDKYLEIKKVEEVSEKSEFMFSLYRKDRVKVQDMKTGESVELLFWSRNFSNKKYAELKPISQAENDKKLPVYGKGRLIKRLIPKNCKIWKVNTTILGDPYYLEKESDSPKDILD

SEQ ID NO: 220 - protein, 1380 aa, Unknown
  Eggerthella sp. YY7918
MNLRHVGNYNIGLDMGTASVGWAAIDEQGELLHFKGKPTWGSRLFDSANTAATARMPRGQRRRYIRRRWRLDLLQKFFSEEMAEKDPEFFIRLRQSSLWPEDREGGHTAYHWPLFNDSDFNEKEYYEKFPTIFHLRQWLMETDEKADIRLIYLAFHNIVKHRGNFLQENNDSLSAQNANMRESLESFCIALEEWCDEKELTCSCDPQKLEHLFKEVKYRSDIRDGFAALLGLACSGENEVDVKAMAKEMGKAIVGYKADFSKIFTECDKEGSSFRLSDDEGPEAFLDICPDDGIALFEAIQMVYSSFILTGMLTEKGLSLSKISAYNQYGQDLESLKALVKEYVPNEYSSFFRGPTYSGSTEYDPSKAQGYTRYNLGPSKKGSGAKPMAYEDFKKSVEQLFANTNAINDERYKEMMGRFAEEKFLRRLRTSDNGRIPFQLNLEEMTAIIINQGKYYPFLLEQQEKLESLVRFRIPYYVGPLTRINARLDSKGNACFAWSKRKDGMDSASIKPWNWDEVIDKHASAQAFIERMTGTCTYLRGEPVLPRCSLLYEEYCVLNELNGARWTQDGDKFIRFDYKDRSDIIEELFKKRRGRIQYAAVADWMKQERSHANVHVSGGQGENAFESRLSSYHFFCNDVFGVDELPGSYVDMVEEIILWSTLFEDRSILREEIQRKYGDVLNEEQIKTICKKRFSGWGRLSRKLLCSLKAQTDNGPKSIMDILQEGDQNNGRVGRAMVFQEILHDEQLGFEQKIEEENTQSMLEGENLLIEDLPGSPAIRRSINQAVRIVDEIVGIAGHAPDNIFIEVTREDDTKKKGKRTTTRYSNIQKALEALKEEGAEALRELKTYKHNELDKRLSLYFMQNGKSLYSGIPLDIRRLSEYQIDHIIPQSYIKDDSYENMALVLPGENQSKADNLLISQDIRIKMKATWTALHKAGLMGDKKYNNLMNSSISDAKMKGFINRQLVETSQSVKLTQMMLSQKYPGAKVRPIKASISSQLRDACDLVKCREANDYHHAHDAYLACQVGRFVLKRHSSMFDNPIGMTKVIRDFVKRQGQEFKRNGKLPAYASRSGFIVQSFMRSGFDAETGELLRDDWNAPFEIARIKRCLNYRDCYISRMPMEDSGAFWDATIYSPKAGKKGALPVKQGLPVEKYGSYSREQFAYFFVYKAYNPKKKAYRLEFEAVPVRVASAVETRENALEEYAKSVAKQAGLEFVEVARPKVYKYQLIELGEDRLYITGKREVRNASQLAFSLDEIDLLKRLAEGEETSSEERERLFDVLIEKYARYAPRLARQLSVDSMSATFETLNAEEQLGILLSLVEIANGKRNMIDLSSAGGSKNAGCMNPTFSSELSSPGSNFTFIDQSVTGMFERRQRLEL

SEQ ID NO: 221 - protein, 1430 aa, Capnocytophaga canimorsus
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSHILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVDKNQQAVLFEEEKTIFELDLEAKQALFNELNLKGNLKAYYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTVNINKAKTEHEKIIKILKNEFGLPNPTRNDIIRYRLYEELKANGYKDLYTNEYIEKQDLFTKNIDIEHIIPKSRVFDDSFSNKTLSFRKTNLDKGERTAFDYIESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVIIDWTKRNDHRHHAMDALTVAFTKHNHIQYLNYLNARKNEKHREHSNIMGIQQLETIKVTDKNGNEKRVFKAPMPNFRQVTKAFLENVLISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLDKNPIWLNKEKGIAIKRVAISGVANAEPLHTKKDHLGKEILDKEGKSIPVDFISTGNNHHVAVYRDEKGNLQEKVVSVFEAVVRANQGLPIIDKTYNQHLGWEFLFTMKQNEMFVFSNESTGFNPNDIDLLDPKNKKIISPNLFRVQKFSKLQYGNSFVREFVFRHHLETTVEDRKELQGITYKQMKNSAFFNDIIKVRINHLGGIVSVGEY

SEQ ID NO: 222 - protein, 1348 aa, Finegoldia magna
MKSEKKYYIGLDVGTNSVGWAVTDEFYNILRAKGKDLWGVRLFEKAKTAADTRTFRSGRRRNDRKGVRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKQQLILLINDLLKIELEEEFMDSIFEILADVNEKKTEKKNILKELINAQDFNKQEGKILYSIFESIVTGKAKIKNIISDEDILEKIKEDNKEDFVLTGDSYEENLQYFEEVLQENITLFNTLKSAYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKYYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPIDTDVKLKLIEELFKKKTKVTLKSIRDYMIRNNFADKEDFDNSEKNLEIVSNMKSYIDFNNILGDKFELEMVEDLIEKITIHTGNKKLLKKYIEETYPDLSSSQIQKIINLKYKDWGRLSRKLLDGITGTNIETGEIDTVINFLRNSSDNLMQIIGSQNYSFNNDIDKLRKKYIPQEISYEVVENLYVSPSVKKMIWQVIRITEEITKVMGYDPDKIFIEMAKSEEGKKTTISRKNKLLALYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYKKSKIIPVKAILASDLRKDMNTLKSREVNDLHHAHDAFLNIVAGDVWNREFTSNPINYVKENREGDKVKYSLSKYFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 223 - protein, 1352 aa, Unknown
  Megasphaera sp. UPII 135-E
MKKRNREEYYVGLDIGTSSVGWAVATPDYRIPKFRGHKMWGSRLFAEGKRAAERRQFRTNRRRLARRRDRLQILEELFAEEMAKVDNTFFMRLKESKFFLEDKTVKEKHILFSTDKFDADRFYKDNPTIYHVRKRLMEEEPQDIRELFLAVHHILKYRGHFLFAGSLEQNGASIEELVRTLLGKQGLAILDDTIDSNEMVNILKNTGETKSDRKKDVQELWNPLKDKVKKAQAAEMAGLVLGLKSDISKLFANSDYKDLDSSIKNINFSSGDYEEKRDDYANSIGDDIVLLDTMKALYDTLILSQILQGKRSISAAKVEDYNTHKEQLRALKAILKPHKRLYNEMFRENNKKDLSNYVAYISSYSEGKRVNREGFYKYVQAVLKQVDDSDSKQAILEAIRLETFLPLLRVKDNAVIPHQIHQAELEAILETARKKYNFLNDVSDGVSVKDKIIQLFTFRIPYYVGPLNPHSGETVADRKQGTGWVVRKQRGKVYPWNFADMVDVKASAEAFITNLTNKCTYLIGEDVLPKRSLLYSEFMLLNELNMIKYDGHELPVAIKQLYIEQVFKQEHKKQTKGRVLDFLKRNGLITGSATAVITGMDDAIKGDLQSYRDMVRIFGAGFDHSMAERIIRWVTLFGEAKDILENKIREVYGNSISDSQMRAIKKLKYADWGRLSQAFLIAVKGCDKSGVERNIITCLRASSQNLMEILSDQGTYIKQIKAWNHQHTTNMMDTLDYQLVDDLYVAPSVKRSIWQSLCIVEELVKIMGQAPKKIFVEVTRTKQAEKTKKDSRKKRLVELYTAIGKEGAAWKKEIEAHQAGDFRRKKLYLYYTQMGRCMYSNEPIAMDALFTSAYDIDHIYPQSLTKDGSWDNLVLVKSQLNKEKSDQYPLRPAIREKNKAHWQYLCRAGFISEKKYERLMRTTELTAEELSGFIARQLVETSQATKAVTGLLERIYTNTEICFVKAETVSQFRHQHNFIKIRELNNYHHAKDAYLNIVVGNVYHEKFTKNPWEFIARSTERRPYNLNRMYDFDLLKQGRVIWQVPKSLETVQAMMKSNDVRITKKLLVQKGELYDATITKAHKAKEGTYFPLKGADARLRDVHRYGGYEKIKIAYYSVFSCREKASNTIHTLIIPIPVYKAGLLQTEADLTAYAWQTKQKTKPIKDIYSAITPIYKKLCINTVVKIDGFKYFLGGKTGDYMWLDPAIPVVLDEQAAAYLKAISKVGRADDVENTAQAIDLITAEANEAFYDVLLKKMEAKIFAKAYQTIVEKLASETARERFRELSIGAQCSCLLEILNLLANNKTTFTFFKDKMGVTMSRRKQPMDLTKLEECIVYETSITGLYEKAVSLL

SEQ ID NO: 224 - protein, 650 aa, Haemophilus pittmaniae
MENKNLHYILGLDLGIASVGWAVVEIDKEENPLCLIDVGVRTFERAEVPKTGESLALSRRLARSARRLTQRRVARLKKAKRLLKLENILLSTDERLPHQVWQLRVEGLDRKLKRQEWAAVLLHLIKHRGYLSQRKNESKSENKELGALLSGVASNHELLQQTTYRTPAELAVKKFEVEEGHIRNQQGAYTHTFSRLDLLAEMELLFSRQQHFGNPFASEKLLENLTALLMWQKPALSGEAILKMLGKCTFEDEYKAAKNTYTAERFVWITKLNNLRIQENGLERALNDNERLILIEQPYEKAKLTYAQVRSILNLSDEAIFKGLRYSGEDKKAIETKTTLMEMKAYHQIRKVLEGNNLKAEWTELKENSTLLDEIGTAFSLYKTDEDISTYLAGKLSQPVLNALLENLSFDKFIQLSLKALYKLLPLMQQGLRYDEACHEMYGDHYGKKTYGKKTEENHYFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKNNAS

SEQ ID NO: 225 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 226 - protein, 1052 aa, Haemophilus parainfluenzae
MENKNLHYILGLDLGIASVGWAVVEIDEKENPLRLIDVGVRTFERAETQKGESLALSRRSARSARRLTQRRVARLKKAKRLLKSENILLSTDERLPHQVWQLRVEGLDRKLERQEWAAVLLHLIKHRGYLSQRKNESKSENKELGALLSGVASNHELLQQATYRTPAELAVKKFEVEEGHIRNQQGAYTHTFSRLDLLAEMELLFSRQQHFGNPFASEKLLENLTALLMWQKPALSGEDILKMLGKCTFEDEYKAAKNTYTAERFVWITKLNNLRIQENGLERALSDNERLMLIEQPYEKAKLTYAQVRSILNLSDDAIFKGVRYSGEDKKAIETKTTLMEMKAYHQIRKVLEGNNLKAEWVALKANPTLLDEIGTAFSLYKTDEDISAYLAGKLSQPVLNALLENLSFDKFIQLSLKALYKLLPLMQQGLRYDEACREIYGDHYGKKTEETHHFLPQIPADEIRNPVVLRTLTQARKVINGVVRLYGSPARIHIETGREVGKSYKDRHELKKRQEENRKQREKTISEIKTLFPNFSGEPKGKDILKMRLYYQQNAKCLYSGKPLELHRLFEQKYVEVDHALPLSRTWDDSFNNKVLVLANENQNKGNLTPFEWLDGKNNSERWRTFKALVETSAFPYAKKQRILSQKLDEKGFIERNLNDTRYVARFLCNFIADNMHLTGEGKRKVFASNGQITALLRRRWGLAKSREDNDRHHALDAVLVACSTVAMQQKITRFVRFKAGDVFTGERIDRETGEIIPLHFPTPWQFFKQEVEIRIFSDNPKLELENRLPDRPQANHEFVQPLFVSRMPTRKMTGQGHMETVKSAKRLNEGISMIKMPLTKLKLKDLELMVNREREKDLYDALKTRLEAFNDDPAKAFAEPFMKKGGAIVKSVRVEQVQKSGVLVRQGNGVADNASMVRVDVFTKDGKYFLVPIYTWQVAKGILPNKAVIQGKDEEDWEDIDDATFQFSLHPNDLISVKTKKDEFLGYFNGLNRHTGGINIRTHDLEKSKGKQGIFEGIGVKIALSFEKYQIDELGKNIRLCKPSKRQPVR

SEQ ID NO: 227 - protein, 1331 aa, Lactobacillus sanfranciscensis
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 228 - protein, 1473 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHNQFTAFVEGIDFKVLPSGKFEKI

SEQ ID NO: 229 - protein, 933 aa, Mycoplasma iowae
SVRDYSDGPGSEKSPTPYGLWRLNKEGKVEKIGENLWDVLVGKCTIYGNDDSIKDEKTKLRGGKNSPIAEVFNFINDLTNIYLFSSSKLKLNSKTKLSILDEFNISLKTSKPIKSFSEKKLVKHIISTTEFKDINFDDVYGYRIDTSKKPLFTKLENTITIAKWLLDNNVYNELNIYDQEDLIKINNIFVILQKSMDINKRAQLVSDEYKIDLPICLELVKKIKGVMQTHSFSYKAMLEYIPVGIKYNDLETGEDTSINASTYFVDKINNLNTKLLFNGRPRKYIPKNIFEDGIISPTSKRAFIQTINVLNKIIKVYSKDYDIDNIAIELPRDKNTAEERKKISSNQKKAGEEIAEVLKFAGLNVEEYTSKLNSKTKLKLKLLKEQNYKDIYDGQEIDVIDVIKNSNKYHEEHIIPYSLCFIDSRRNKVLTKFENNKQKGNKTPFQWLSSIGKYAEFKDRVEKLFVEQKISKAKKELLLFEQDPRTEMLGFIEKNLSDTRYASKLVFDTFRDFFKVNNPNVKIKVINGALTNYARYNLFATYKDGLLERKGIMKQREFYEHHGIDATILAFLGSNHKINQLLKLSHKFKKQDDNKIYDENTGELIEFTKDFLSDEARKKAMELSKQIFEIPCKFSRPIYRKSNVSFSNETLISMKWIDDKYTKGVKINKLSLVNKDLDLNEYFADYETNEMKNLICYQEDKTLYNKLKNIYDKYNNFVENSNIKPVKNPFINYMISNFSSDDSKIQNFKHIIFYDHKGNKKFVKSLKVCGDEKNLSNIVLRKDQKDIMNSKKIKKSGILESLNPISARIYKDNKGKYITIPINSLVLNWTKKGLEIDNEKLCNILKSKNIFNNQFIEINAGQSIINNENKLFYFVGGGDFKVNKLEIKSQFCDNEIFFPRKQMNISIATIIDNYKLCEVDELGKIYNIRKIVL

SEQ ID NO: 230 - protein, 1358 aa, Acidaminococcus intestini; identical to SEQ ID NO: 94

SEQ ID NO: 231 - protein, 983 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 232 - protein, 1338 aa, Streptococcus macacae
MTKPYSIGLDIGTNSVGWAVVTDGYKVPAKKMKVLGNTDKSHIKKNLLGALLFDSGNTAKDRRLKRTARRRYTRRRNRILYLQEIFAEEMAKADESFFQRLNESFLTNDDKEFDSHPIFGNKAEEEAHHHKFPTIFHLRKHLADSTEKSDLRLIYLALAHMIKFRGHFLIEGQLKAENTNVQTLFDDFVEVYDKTVEESHLSEISVSSILTEKISKSRRLENLIKYYPTEKKNTLFGNLIALSLGLQPNFKTNFKLSEDAKLQFSKDTYEEDLGELLGKIGDNYADLFISAKNLYDAILLSGILTIDDNTTKAPLSASMIKRYEEHQEDLAQLKKFIRQNLPDQYSEVFSDKTKDGYAGYIDGKTNQEAFYKYIKNMLSKTEGADYFLDKIDREDFLRKQRTFDNGSVPHQIHLQEMHAILRRQGEYYPFLKENQDKIEKILTFRIPYYVGPLARKGSRFAWAEYKADKKVTPWNFDDILDKEKSAEEFITRMTLNDLYLPEEKVLPKHSLVYETFNVYNELTKVKYVNEQGKAIFFDANMKQEIFDHVFKENRKVTKDKLLNYLNKEFEEFRIVNLTGLDKENKAFNSSLGTYHDLRKILDKSFLDDKVNEKIIEDIIQTLTLFEDREMIRQRLQKYSDIFTTQQLKKLERRHYTGWGRLSAKLINGIRDKQSNKTILGYLIDDGYSNRNFMQLINDDSLPFKEEIARAQVIGETDDLNQLVSDIAGSPAIKKGILQSLKIVDELVKVMGHNPANIVIEMARENQTTAKGRRSSQQRYKRLEEAIKNLDHDLNHKILKEHPTDNQALQNDRLFLYYLQNGRDMYTEDPLDINRLSDYDIDHIIPQSFIKDDSIDNKVLVSSAKNRGKSDNVPSEDVVNRMRPFWNKLLSCGLISQRKYSNLTKKELKPDDKAGFIKRQLVETRQITKHVAQILDARFNTKRDENKKVIRDVKIITLKSNLVSQFRKDFKFYKVREINDYHHAHDAYLNAVIGKALLDVYPQLEPEFVYGEYPHFHGYKENKATAKKFFYSNIMNFFKKDDIRTDENGEIVWKKDEHISNIKRVLSYPQVNIVKKVEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 233 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 234 - protein, 1535 aa, Flavobacterium columnare
MTKILGLDLGTNSIGWAIRDTENEGINQILDKGARIFSEGVKSENGKEISRAAERTAYRSARKIKYRRKLRKYETLKVLSINGMCPLSVEEVEQWKKSGFKEYPLNPEFLDWLRTNEDKNINPYLFRDKASKQKVTLFELGRALYHIAQRRGFLSNRLDQSAEGVFEEHNPQIQNLIEDLDSSNTILNELKEYYINLGIIDETEKSGFKKDLDEGEKKLKSLYNSLVAITKKNANDIETCKQELIARLNKKEDLGKVKGKIKDISQAMLDRNFKTLGQYFFSLYNKERIRNQYTSREEHYLEEFIIICQTQGIEGINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKSDFNFEVLAKELVEKGASFGYYKSSKKNEFFYWFNYKPTDSVSACVVSASLENAIGKDWKIKTFEYQTRNTEKNEVTKSVDYKDLWHLLSVATSDTYLYDFAIEKLKLEPKNAKAFSKTKLKKDFASLSLAAIAKILPYLKQGLLYSHAVFMANIENIVDADIWKDEEQQKFIQSKIVELVDNYIVEKSKLELINGLLKIYNTEDKEGRKVYYSKEAESLFEADLRKKLVPFYKANIIIEEHEQEIIFQDLFPILMDQLKKQEFIKIGRLDKQIEAFLEGENEEGQIFCNHTDKLKKLYHPSDIEVFKKKTIKDEWGNEKVVLGSPLTTSIKNPMAMRALHQLRKVLNTLIANDQIDEDTRIHIEMARELNDANKRKGIQDFQNENKKFREEAIKEIKKLYLEECHKDVNPTEDDILRYQLWLEQGKCEIYEEGNNISICDIIGSNPSYDIEHTIPRSISQDNSQMNKTLCSLKFNRSIKKQKMPVELSNYNDILPRIAHWKKEAEELTRQIETISRSIKSAATKVAKDKNIRKRHYLTLKRDYILGKYERFTWEEPKVGFKNSQIPDTGIITKYAQAYLKSYFKRVESVKGGAVAEFRKLWGIQESFIDENWWKHYKDKDRDKHTHHTIDAITIACMPKDKYDLLAHAWRLEDEQDKKAAKVLIEQAKPWKTFKEDIEKIETEILVSHFTPDNVKKQSKSIIKNRGKKVYVLKNELPVNFKNKIEGKDYFKLKFDSKILYKIPKKKEKQTDTFYEELPKNYLNGVEGKDYFKINTTGKTFYKIPIFNQGDTIRGSLHQETTYGAIKLPDIDIETKKPLHTDKGGFILKKDIKGNEIVFFVVRKEISKISENDVQNIVDNVVRKKIENAIANSLITFKIVKKKKVAVIKEGVTIWMREPNIEKGIEGIPIKKVRIITNSVKNPIEIKVHSPLSKSRHKHKQKVYGQNDENYAMALYELDGKREFELINNFNLAKLLKQSQSYYPLHKEKEIKGKKILVPIEKRNNKDVILKRGQQVVFYDKTVENPKDISEIIDFRERIYIIEGLTIQRQKDKKTSKVNEYGIIQLRHFKEARKSEEISKDNFKPDGEFKINENKPTRKMNHNQFTAFVEGIDFKVLPSGKFQKI

SEQ ID NO: 235 - protein, 1459 aa, Flavobacterium columnare
MKFNLGLDIGTNSIGWALVNEDYENKKGKIIAAGSRIIPMTQDILDKFGSGAITETQTALRTDYRSKRKLIQRFLLRRERLHRVLNVLDFLPKHYAESIDFEKYFGKFLPNTEPKLAYNQNQFIFQNSFLEMLKEFQEKHPELLTNNKKIPYDWTIYYLRKKALNQRIEKEELAWLLLQFNQKRGYNQLRDEEEESVPNKQVEFYSLKIIDVVADQPKEGRDKRWYSINLENGWTYRRESKTPLFNWEGKTKDFIVTTDLNQDGSIKKDKEGKEKRSFRAPSEGDWTLLKKKTEKEIYESGKTLGTYIYDALLNTPDLKIKGDFIRTIDRSIYKEELQQIINKQKEYHLELNSSKLYKACLEELYPKNEIYKSALKNKDIAYLFINDILYYQRPLKAPKYNIGKCTYESRTFKKEDKKIREYIPAVAKSHPLFQEFRLWQWIKNLKIYEKLSSDNCTDFFLTNEQDFENLFEFLWNKKEIDHKGILEYLVKTKFPDLKPKQVKTKVKEYRWNYVYDHEKDESKTYPCGETYFLLKNKLDKIYNAQDDFLDKERLYNLWHIIYSVTDKKQYEKALAKFALKNHLDTKSFVNTFKRIPPFKNDYAIYSLKAIKKLLPLMRVGKYWNYDDIDPITKQKIQCIITGEENDTISTLVREKTNHFSNENDFKNLPLWLAGYIVYNSHNESSEIEKWKSPQDIDTFLKKFKQHALRNPIVEQVVTETLRVVRDIWSKKGQGKKDFFNEIHIELGKDLKNPVDKRRKLSSTNTKNESTNTRIKALLIELFTQGVENVKPNSPKHQEILKIFEEGALNSGIEIEEDIIKISNTDQPTKKQLELYILWLEHKYKSPYTGQSIPLSKLFTPNYEIEHIIPRSKYYDDNLSNKVICETEINRLKNNQLGYEFINNHEIREVTLEEGKTIRLLSPEQYWNFVTTYYAKNKAKRENLLLKELPVQMVEKQLNDTRYVSKYVMQLLSKIVRKEDGTDNGINSTNILSISGKMTRALKNDWDLNDVWNDLLLYRFERLNTITKTNLFTTYSEQKQKRMPIVPDQYAKGFHKKRLDHRHHALDAIVIACITRNHINYMNNQNIQGEKLKKNAIEKENYREILQKSRLDIRAQLCEKKYNDNDPTKYNWVFIKPWADFTENTKDILESIIPSFKQNLRIINKTVNYYEKYNENGKKVKVRQIKGDNWAIRKPLHKETISGKVHLSYKTPAKGKILTATRKVLDSSMDFKSIEKITDTGIQKILKNYLEYKKSPELAFSPEGIEELNATITKYNNGFHHKPIYKVRIYEEGVKFPLGNKGNKKSKYVEAEKGTNLFFAIYKDQENNRYFETIPFNDVLETLKKGMSAVPEKNQEENTLVFALSPQDLVFVPTLDEIENPDIVDFKNLTKDQTNRIYKMVSSSGKQCFFIKAEVATSIVNKMEFSTSNKMENSIEGIQIKSNCWKLKLDRLGTITRVIK

SEQ ID NO: 236 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 237 - protein, 1425 aa, Prevotella micans
MIQKIFGLDLGTNSIGSSVRNLELGENLTEQLEFFSSDIFGSSVSKNSNGREYSLAGNRSAHRRSRGLNEARRRKLWATLDLLIEHGLCPMSPDSLMQWRTYDKQKGLYRQYPIEDKDFNAWIMLDFNGDGKPDYSSPYQLRRELVVRQFDFDQPIERYKLGRALYHIAQHRGFKSSKGETIADQEKNEKKPIAEEGADIANEMKASETKLSKGLVAYMQENHLKTVGEAFAKLEDERVRIRNNESYRAIRSQYQDEIKEIFTYQKKLSVESELYERLTSEKKGVGTIFYKRPLRSQRGNVGKCTLERNKPRCPIGRPEFEEFRAWTLINNIKIRETAGEPYKQLPIKLRQELLKDCFLSKVKADFKFEDIRKYIEKRLGLSFSNDDKTINYKDSVSIAACPVTVRMKKLLGENWANCRIDGEKRRQAHGKNNNNEHIVSYTEEDIWHVCYNAEDPEEVSNFARKALHWDENKIKELVRLWTSIPQGYAMLSLKAIRNINRMLLLGLKYSDAVLLAKLPDIVPVSDEDILAITKEFLQLEDKLNQEKQINNIVNSLIANYKSKLEENRFADHNYQYQLGEGDDEDINTQIKSHIGAKLWVQIGADEQTKIFQAVRSKYQDFFKSYKRKFVESPKLGELLVAFLTEKFPNVKSKQWERLYHPSQIAIYRPIPVDNDRSKLRLGNPNIGAIKNPTVMRVLNTLRRRVNQLLDDGVISPDETRVVVETARELNDANTKWALDRYNRIRRDENEKIRKILKELNPTTNSISEQDIDKARYIFEQCETDFYTDGKVPYYNKDIKKYKLWLEQGGQCLYTGQTINLTNLFNPNAFDMEHTIPKSISFDNSDQNLTLCESYYNRFIKKNNIPTDMPNYDKDVTINGKEYTAIKPRLQRWKERVDRLSRNVDFWKGQARRAQDKDRKDECIREKHLWDMELAYWKGKLERFTMTDVTDGFKNSQLVDTRVITRHAVLYLKSIFNHVEVQRGETTAEFRKILGLQSIDEKKDRSLHSHHAIDATMLTVIPSAAKRDRMLELFYKIEETKKALKNYNDNNKTGLNLELKGLEEKLDKEKKDCRVGRRVNDLDRFINENIIVSHHTKDQALTPAHRRLRKRGKIVGGKEHPRWQTGDSLRGEIHKASYYGAITQFAKDANGKVLMKDGQAQIDPTIYYVIRRELKYKRSTQDSGFTNWEDLEKVIVDTDLFGLMKGQFPEGTSFKDACEQGFYMIKKGKNGEGDVKTHRIRHVRCKAVKTALRIKEQTYKSSKDYKQFFYAAVGDLYVMCYYTDGKKRDFKIYSLYDISNHRKSGTEDIPKFITDKKGNHLPLDYKLRTGDMVLLYKDNPEELKDLDQVNLKRRLYKVNRFESEGLIILLTHHLSTTTERGCSIGKIENYQNLPTAIRCGIKTIKFLIMGKHRDFVIRNGNIEFKH

SEQ ID NO: 238 - protein, 1473 aa, Mucilaginibacter paludis
MKNILGLDLGTNSIGWALIEKDTDQKNGNILGTGSRIIPMSQDIKDEFGKGNSISQTADRTKFRSVRRLRERHLLRRERLHRVLNVLGFLPKHYADQIDFKKRLGKLVNETEPKLVYDNKNFIFKKSFEAMLSDFNQHQPLLLADGKKVPFDWTIYYLRKKALTEKIEKEELAWLILNFNQKRGYYQLRGEEEEENPNKMVAFHSLKIVEVIADESQKGKAETWYSLILENGWIYRRSSKTPLYDWKGKQRDFIVTTDLNDDGSIKTDKEGLEKRSFRAPVEDDWTLVKKKTEQEINRSHKTVGTYIYENLLQDPKQKIKGKLVRTIEREFYKDELKMILKNQQKFHPELNDEHLYINCVRELYRNNQAHQTILSKKDFVHLFIDDIIFYQRPLRSQKSSISNCTLEFRKYKNENGTDQTDYLKAIPKSHPLFQEFRLWQWIYNLGIYQKEDDTNVTDELIKNIDGYQDLFDFLNNKKEIRQDILIKFLVEQTGLKGKPLSSVVAKYRWNFVEDKIYPCNETGTQIRTRLAKVENTPEDFLTAETEIKLWHIIYSVNDKADYEKALKTFAEKHNLDTHSFVENFKKFPPFKSEYGSFSEKAIKKLLPLIRLGKYWSWENIDKKTQERIEKILTGEFDEAIKSRVRDKAIHLTEEDHFQGLQLWLASYVVYGRHSEADNLDKWHTVADLEDYLAEFRQHSLRNPIVEQVITETLRVVKDIWLQYGQGAKDFFSEIHIELAREMKNTGDERKRLTSLVTDNENTNLRIKVLLSELLNDGNVENVRPYSPMQQEALKIFEDGVLNSDIEIEDDILKISKMAQPTNTELKRYKLWLEQKYRSPYTGQIIPLNRLFTADYEIEHIIPQSRFFDDSFSNKIICESAVNQLKDKQLGLEFIKNHSGTIVKLGMGKTAKILDVESYNEFVKGNYTKNISKRNKLMLEEIPDKMIERQLNDTRYISKFIISALSNIVRSESNDDGFNSKNVLPGNGKITSRLKQDWGMNDIWNELILPRFERMNKITDSAVFTAWNENNQKFLPIVPLEFSKGFQKKRIDHRHHALDALVIAASTREHINLLNNEHAKSDKRFDLNRKLRKFEKVAYNDPKTGKRIEKEVPTIFLKPWETFTVDAKNSLESIIVSFKQNLRVINRATNYSESYNDENGALRLGKDGNPLKEKIKQSKGDSWAIRKPMHKDFVYGKVHLQNVKLPKDKFITAIRKSLDVTFDLKRIETITDTGIQKILKNYLHSKENKVELAFSPEGIEDMNQHIERYNDGKKHQPIHKVRVFEIGSRFSLGESGNKKTKFVEAAKGTNLFFAVYQDDNKGKRNYETIPLNIVIERQKLGLHSVPTEDAKGGKLLFHLSPNDMVYVPTSEELEDNLASVNIKRLNTAQRKRIYKVEKASGVECYFIRQDIAYLIKNYDAKTKIGELESQNKLQTTMTDDRLKITDVCVKLNIDRLGSIAETFLGNQYGASKKT

SEQ ID NO: 239 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 240 - protein, 1130 aa, Streptococcus macedonicus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVPTETGKLSTEQKESLVEFAKNTAILGPAKLLKEIAKILDCKVDEIKGYREDDKGKPDLHTFEPYRKLKFNLDSVNIDYLSREVLDKLADILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFINKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKSLNKPNISIYKVRTDVLGNKYFVKKEGDKPKLDFKNNKK

SEQ ID NO: 241 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 242 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 243 - protein, 1375 aa, Lactobacillus johnsonii
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGQLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKAIFNKTRKFSFISQLLKNKSENSKEIAKKLKRAYQFKYMLVSRETETRDQEMFKMTVYPRFSHDTVKAPRNLIPKKMGMSPDIYGGYTNNSDAYMVIVRIDKKKGTEYKILGIPTRELVNLKKAEKEDHYKSYLKEILTPRILYNKNGKRDKKITSFEIVKSKIPYKQVIQDGDKKFMLGSSTYVYNAKQLTLSTESMKAITNNFDKDSDENDALIKAYDEILDKVDKYLPLFDINKFREKLHSGREKFIKLSLEDKKDTILKVLEGLHDNAVMTKIPTIGLSTPLGFMQFPNGVILSENAKLIYQSPTGLFKKSVKISDL

SEQ ID NO: 244 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 245 - protein, 1063 aa, Simonsiella muelleri
MEKFHYVLGLDLGIASVGWAAIEIDKETETSIGLLDCGVRTFERAEVPKTGDSLAKARREARSTRRLIRRRSHRLLRLKRLLKREIFRQPETFKDLPINAWQLRVKGLDSRLNEYEWAAVLLHLVKHRGYLSQRKSEMSETDSKSEMGRLLAGVAENHQLLQQEQYRTPAELALKKFVKHFRNKGGDYAHTFNRLDLQAELHLLFQKQRELGNPFTSPELERQVDDLLMTQRSALQGDAILKMLGHCGFEPEQFKAAKNTFSAERFIWLTKLNNLRIQDQGKERALTADERTKLLDEPYKKSKLTYAQVRKLLSLPQTAIFKGLRYDLEHDKKAENSTLMEMKSYHNIRQTLEKSGLKTEWQSIATQPEILDAIGTAFSIYKTDEDISHELKTCRLPENVLNELLKNINFDGFIQLSLTALRKILPLMEQGYRYDEACTQIYGNHHSGSLQQESKQFLPHIPIDDVRNPVVFRTLTQARKVVNAIIRRYGSPARVHIEMARELGKSKSDRDRIEKQQQKNKKERENAVAKFKEDFPDFVGEPRGKDILKMRLYEQQHGKCLYSGHDIDINRLNEKGYVEIDHALPFSRTWDDSQNNKVLVLGSENQNKRNQTPDEYLDGANNSQRWLEFQARVQTCHFSYGKKQRIQLAKLDDETEKGFLERNLNDTRYIARFMCQFVQENLYLTGKGKRLVFASNGGMTATLRNLWGLRKVREDNDRHHALDAIVVACSTASMQQKITKAFQRHESIEYVDTETGEVKFRIPQPWDFFRQEVMIRVFSDQPCEDLVEKLSARPEALHDNVTPLFVSRAPNRKMSGQGHLETIKSAKRLSEENSMVKKPLTTLKLKDIPEIVGYPSREPQLYAALKTRLETHDDDPIKAFAKPFYKPNKNGELGALVRSVRVKGVQNTGVMVHDGKGIADNATMVRVDVYTKAGKNYLVPVYVWQVAQGILPNRAVTSGKSEADWDLIDESFEFKFSLSRGDLVEMISNKGRIFGYYNGLDRANGSIGIREHDLEKSKGKDGVHRVGVKTATAFNKYHVDPLGKEIHRCSSEPRPTLKIKSKK

SEQ ID NO: 246 - protein, 1509 aa, Psychroflexus torquis
MKRILGLDLGTNSIGWSLIEHDFKNKQGQIEGLGVRIIPMSQEILGKFDAGQSISQTADRTKYRGVRRLYQRDNLRRERLHRVLKILDFLPKHYSESIDFQDKVGQFKPKQEVKLNYRKNEKNKHEFVFMNSFIEMVSEFKNAQPELFYNKGNGEETKIPYDWTLYYLRKKALTQQITKEELAWLILNFNQKRGYYQLRGEDIDEDKNKKYMQLKVNNLIDSGAKVKGKVLYNVIFDNGWKYEKQIVNKDEWEGRTKEFIITTKTLKNGNIKRTYKAVDSEIDWAAIKAKTEQDINKANKTVGEYIYESLLDNPSQKIRGKLVKTIERKFYKEEFEKLLSKQIELQPELFNESLYKACIKELYPRNENHQSNNKKQGFEYLFTEDIIFYQRPLKSQKSNISGCQFEHKIYKQKNKKTGKLELIKEPIKTISRSHPLFQEFRIWQWLQNLKIYNKEKIENGKLEDVTTQLLPNNEAYVTLFDFLNTKKELEQKQFIEYFVKKKLIDKKEKEHFRWNFVEDKKYPFSETRAQFLSRLAKVKGIKNTEDFLNKNTQVGSKENSPFIKRIEQLWHIIYSVSDLKEYEKALEKFAEKHNLEKDSFLKNFKKFPPFVSDYASYSKKAISKLLPIMRMGKYWSESAVPTQVKERSLSIMERVKVLPLKEGYSDKDLADLLSRVSDDDIPKQLIKSFISFKDKNPLKGLNTYQANYLVYGRHSETGDIQHWKTPEDIDRYLNNFKQHSLRNPIVEQVVMETLRVVRDIWEHYGNNEKDFFKEIHVELGREMKSPAGKREKLSQRNTENENTNHRIREVLKELMNDASVEGGVRDYSPSQQEILKLYEEGIYQNPNTNYLKVDEDEILKIRKKNNPTQKEIQRYKLWLEQGYISPYTGKIIPLTKLFTHEYQIEHIIPQSRYYDNSLGNKIICESEVNEDKDNKTAYEYLKVEKGSIVFGHKLLNLDEYEAHVNKYFKKNKTKLKNLLSEDIPEGFINRQLNDSRYISKLVKGLLSNIVRENGEQEATSKNLIPVTGVVTSKLKQDWGLNDKWNEIIAPRFKRLNKLTNSNDFGFWDNDINAFRIQVPDSLIKGFSKKRIDHRHHALDALVVACTSRNHTHYLSALNAENKNYSLRDKLVIKNENGDYTKTFQIPWQGFTIEAKNNLEKTVVSFKKNLRVINKTNNKFWSYKDENGNLNLGKDGKPKKKLRKQTKGYNWAIRKPLHKETVSGIYNINAPKNKIATSVRTLLTEIKNEKHLAKITDLRIRETILPNHLKHYLNNKGEANFSEAFSQGGIEDLNKKITTLNEGKKHQPIYRVKIFEVGSKFSISEDENSAKSKKYVEAAKGTNLFFAIYLDEENKKRNYETIPLNEVITHQKQVAGFPKSERLSVQPDSQKGTFLFTLSPNDLVYVPNNEELENRDLFNLGNLNVEQISRIYKFTDSSDKTCNFIPFQVSKLIFNLKKKEQKKLDVDFIIQNEFGLGSPQSKNQKSIDDVMIKEKCIKLKIDRLGNISKA

SEQ ID NO: 247 - protein, 1112 aa, Staphylococcus simulans
MLVGLKFKQSILFENMENAEDIKESATGSDAISLSDDYYENLSEFLTDEQLNFIESANTFFMGIMLDRILKGATSISAAKVRDYKIFKSQLKLIKDIVYQNKYDKYHEFFVTSKEDMRAYQENPDAKNFGKLSKFDQYLIHSKDQYAKLMKDLKGLVPKEYTEVLNLIDEQKFLVVQNTTDNASIPYQNNVFEAENILRNQQKYYPEITEEMIGKVINLISFRIPYYVGPLTNKNGQSDFAWMIRKSDEQTLPWNFDKVIDKSKSAEKFIRRMTSKCTYLLEEDVLPKHSLLYQEMEVLNELNNVQLRGENEPKHRIHRLDPKVKQFIYHNLFQKKKNVTHKDLITLLQNSEHRNTLNKTSGQKLKVFGTQNDSKFASKLSTYNDMKAILGSVENKRQMIEELVLWITIFEDKAILKQKIGEKYPNITEKQLNQIVKLNYSGWGRLSEKLLTKEVNGRSLIDLMYSTENNFMEIITDKTLGFDCFIKNSNKVKNAKISYKDVAELRTSPALKKGIWNAIKMVREISNLFGAPEKIIIEFATEDQAKGKRQKSRSELWDDLVKKNNLKRNKEFEGLFEELKAYPDLDFSNPKLWLYIHQNGKCMYTKKPIDLERLMSDTNNQLYEIDHILPRTFVKDDSINNKVLVIQSANQKKSGDKMPLEIFDNHVLVPFWKMLYENDLISSSKLSKLMKKEFNDLDKEGFIQRQLVETRQIISHVSDFLTEEYPSTTVVPMKANVVSELRRKFDIPKIRQLNDWHHAVDAYLNGFVYQAARVFYPKVNLFEFNFKWEKVREKWRQLGEFTENNKKREFFLFKRMENYVNEYGEGMISKLIFDLDNFKFNYSRKVESTESAFYKQSAFSPKNTTAQYDSDKNKTAIYKEMKNKRGIVVSYTYVKKDQELIGYGVFNETVFEYVNNADVDMNTRALKIVRKAFPKLDIKKAQYLFSINKGDALLVNGHPFLFVSAYERINGKQLEFDIAMQRKIKQALSPYNNMTEQEKVEFYNQFAEKVIEEFRNSIGLQSRDRKVNLIKNLFNNTEKSNDSMTQSILEVLKMTKVSAERSKELKIRWNGQTPNTFIDTKNNAEIQYKSITGLKTTKPKSIFKLAESKNEL

SEQ ID NO: 248 - protein, 1274 aa, Mycoplasma gallisept
MNINMNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 249 - protein, 1122 aa, Artificial Sequence; identical to SEQ ID NO: 18
  Synthetic amino acid sequence

SEQ ID NO: 250 - protein, 1236 aa, Artificial Sequence; identical to SEQ ID NO: 16
  Synthetic amino acid sequence

SEQ ID NO: 251 - protein, 1059 aa, Artificial Sequence; identical to SEQ ID NO: 10
  Synthetic amino acid sequence

SEQ ID NO: 252 - protein, 1166 aa, Artificial Sequence; identical to SEQ ID NO: 34
  Synthetic amino acid sequence

SEQ ID NO: 253 - protein, 1149 aa, Artificial Sequence; identical to SEQ ID NO: 32
  Synthetic amino acid sequence

SEQ ID NO: 254 - protein, 1314 aa, Artificial Sequence; identical to SEQ ID NO: 22
  Synthetic amino acid sequence

SEQ ID NO: 255 - protein, 1064 aa, Artificial Sequence; identical to SEQ ID NO: 33
  Synthetic amino acid sequence

SEQ ID NO: 256 - protein, 1401 aa, Artificial Sequence
  Synthetic amino acid sequence
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAYPYDVPDYASLGSGSPKKKRKVEDPKKKRKVD

SEQ ID NO: 257 - protein, 1368 aa, Artificial Sequence
  Synthetic amino acid sequence
MDKKYSIGLAIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 258 - protein, 1368 aa, Artificial Sequence
  Synthetic amino acid sequence
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 259 - protein, 1368 aa, Artificial Sequence
  Synthetic amino acid sequence
MDKKYSIGLAIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 260 - protein, 15 aa, Artificial Sequence
  Synthetic amino acid sequence
IGLDIGTNSVGWAVI

SEQ ID NO: 261 - protein, 8 aa, Artificial Sequence
  Synthetic amino acid sequence
IVIEMARE

SEQ ID NO: 262 - protein, 27 aa, Artificial Sequence
  Synthetic amino acid sequence
DVDHIVPQSFLKDDSIDNKVLTRSDKN

SEQ ID NO: 263 - protein, 8 aa, Artificial Sequence
  Synthetic amino acid sequence
HHAHDAYL

SEQ ID NO: 264 - protein, 240 aa, Acetobacter aceti
MANIAENLVFGIDLGIGSCGWAVLNQKAKDENIVALGSWCFDVPETDKERIPTNQIRRANRLLRRVIRRRRNRMAEIRRLFASKGMLDTADPDALAKISADPWEMRAKGLDYQLTPQEFAVALGHIAKRRGFKSAAKRVSTNAPSEDSKMLAALEKTKEQSAQYRTIGEMFARDPAYADRRRNRDGCFDRTMSREDLFKETQILFESQRRLGNFSATSETEQAFIDIAFRQKPMQDSERL

SEQ ID NO: 265 - protein, 400 aa, Acetobacter aceti
SFERFRLLCRLVNLRVTDGLEDRPLTPEELRLACEDAGKTRKLSVKKVRSLIGLRDDQRFTTIPPDQEQHDIAARTGDALTGTATFRAILGESFWRQLLPHPEQLDRAAWIISFHELTDTIISKLATIGLPSEVMELIRKALEDGKFSKFKGAASLSDKAARKLIPFLQEGLTYDKACQKAGYNHAASKFTHYDSIDTKAKFNSLMDDVRDSITNPVARKAISEGMKQVWAMRNQWGLPGAICIELARDVGNSAEKRREIESGIKKNTAQRERERQEAKEHLNQSDISSETLLRYRLWKEQGGRCCYTDQPITPSQLIASDNSVQVDHILPWSRFGDDSYLNKALCTAKANQEKKNRTPWEWIHNQKGVEAWNHFTAAVESRKETRGLKKRNFLLKSSKE

SEQ ID NO: 266 - protein, 376 aa, Acetobacter aceti
YAARVMAEAVRLLYPSGNRAEKGGVKRVFTRPGALTAALRHAWGVESLKKINGKRLNDDRHHALDAAVVAAVSEKEIQKLTKSFQICEQKGLARPMRDVPMPWEGFRHQLETAYADIRVARPERRRARGKGHDATIRQLREEKDGPVVYERRAISDLKLTDLERIKDPERNSAIISSLRTWIEKGKPADYPPQSPKGDEIRKIRVMSRNKPAVSVRGGTADRGEMTRVDVFTKMGKKGKPEWFLVPIYRHQVIDRIQWPQPPNQAAANGKSEKNWPTMGLEHEFRFSLYPRSYVQIVKRDGEIIEGYFAGLDRTVAAFSLLSSSDPTSIQRGIGAKTLESIRKYNVNRFGDISMVEQETRTWHGDVCISPDQPDSA

SEQ ID NO: 267 - protein, 1054 aa, Actinobacillus suis
MKLTPLNYILGLDLGIASVGWAVVEIDEQENPLGLIDVGVRTFDRAEVPKTGESLALARRLARSARRLVKRRADRIKKAKRLLKAENILLSADEHLPNDVWQLRVKGLDQKLERQEWAAVLLHLLKHRGYLSQRKNESKSENKELGALLSGVETNHQILQSAEYRTPAEIAVKKFHVEDGHIRNQRGAYTHTFSRLDLLAEMELLFQRQTDLGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKQRESAVKKFKEYFPNFVGEPKGKDILKMRLYELQQAKCLYSGKSLELHRLLEKGYVEVDHALPFSRTWDDSFNNKVLVLANENQNKGNLTPYEWLDGKNNSEHWQNFVARVQTSGFSHTKKQRILSHKLDEKGFIERNLNDTRYVARFLCNFIADNMLLTGKGKRKVFASNGQITALLRGRWGLQKVRDDNDRHHALDAVVVACSTVVMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLSDLERMVNREREVTLYESLKARLEQFGNDPAKAFAEPFHKKGGAVVKAVRVEQTQKSGVLVRDGNGVADNASMVRVDVFTKGGKYFLVPIYTWQVAKGILPNKAVTANVDEIDWLEMDESYQFIFTMYPNDLVKVKLKKEEFFGYYGGLDRATGAIVIKEHDLEKSKGKQGIYRIGVKLALSFEKYQVDELGKNIRPCRPTKRQHVR

SEQ ID NO: 268 - protein, 239 aa, Actinobacillus ureae
MEIRIFSENPKLGLENRLPGYPQYNHEFVQPLFVSRMPTRKMTGKGHMETVKSAKRLDEGLSVLKVPLTQLKLSDLERMVNREREDALYQSLKAHLEQFGNDPAKAFAEPFHKKGGTVVKAVRVEQTQKSGVLVRDGNGVADNTSMVRVDVFTKAGKYFLVPIYKWQVAKRILPNKAVTAGVDEIDWLEMDSSYQFIFTMYANDLVKVKLKKRSILGLLRWFRSCNWGYCYQRTRFREI

SEQ ID NO: 269 - protein, 400 aa, Actinobacillus ureae
MKLTPLNYILGLDLGIASVGWAVVEIDEQENPLGLIDVGVRTFDRAEVAKTGESLALARRLARSSRRLVKRRADRIKKAKRLLKAENLLLSADEILPNDVWQLRVKGLDQKLERQEWAAVLLHILKHRGYLSQRKNESKSENKELGALLSGVATNHQLLQTAEYRTPAEITVKKFQAEENGHGHIRNQRGDYSHTFDRKDLLAEMKLLFQRQAELGNPHTSEKLLENLTTLLLWQKPALAGEAILKMLGKCTFEPAEYKAAKNSYSAERFVWLTKLNNLRILENGIERALTDNERFTLLDQPYEKAKLTYAQARTMLALSDEAIFKGVRYQGEDKKAAEKVALIEMKGYQHIRKALEGAGLKAEWNELKNNSELLDDIGTAFSLYFSISNLPTEIAYFTP

SEQ ID NO: 270 - protein, 1113 aa, Actinomyces georgiae
MSASSQNVERIRYKVGIDVGLRSIGFCAVQVDADDRPVKLLNTVVHVHDAGVSPADAKKADTRKLVSGVARRTRRLYRTRKRRLVDLDRQLDGLGWPLVDPARFADPREPWFAREKLVSGRVDDADERKELLSVALRHIAHHRGWRNPYSTVESLQADAPPSEFLQGLNQRVSEKLGTELDPGLTQGQLVAKLLHRFPNAKIRGPEGILRGKLHQSDNAGELRLICRTQGLDCHITEELVRLVFQAKSPKANKEMRKRIGRDQLPGQGAHIRAEKAHPVFQRFRIVAVLANLRIREAHVDRRLTAEEMRTLTDFLLGLAGSEQPTWEELADNLNIERHQLRGTAKASVDGAPALRFPPIDATTDRIYASKLKWLAEWWRQADEERRGYMVDALSNSGGSEDEPYLDDEIAEMLEQASEEDQAKLDSLHLPGGRASYCLDTLRRLTDAMLGGGLDLFEARKAVFHVDDDWAPPTDPIGAPVGNPPVDRVLKHVARWLEAATGRWGAPQTINIEHVREGLGSEKAARELTRMNDRRRRNNQKLVEEMGEKLGMSGRIRRSDRMRYEAIRRQNCECLYCGQPITYQTMEMDHIVPRAGAASTNSRSNLAAVCRRCNHQKGKLPFAVWAESQDSPAEVRLQDAVQRVRHWLRDAGMGQKELQALRVQVIARLKSKRPDEEFDGRSMESIAWMANELRARVEAQYRGSGTTVRVYRGALTAEARKASGFEGRVNLIGGRGKDRFDRRHHAMDALVIALMNQSVAQTLALRLNMRDSQWLTQSEQTWRQFHGAPGEAARKWEAWDRDMRDASDLFNLALDGGRIPITENVRLRVGNGRVHEDGVIRFKPEYEVKGKTIKGGEARLLGDSLPSEQIDRAETPALWTALTRLPEYDRKSGLPENPDRVIRVNGAVVQATDRIRFFGTPASVAVRGGYAKLGESIHHARIYRINGKTPKYAMIRVYTIDLMRLNHEDIFTAVLKPSTISMRCAEKKLKYAIAEGNAEQIGWLVEGDQLELDAAAYAKGVGADLMREYPMATCWRVAGFPDEAKLRLRPVLLAAEGMGEDAPKFMREVLENQGWRPAVNALLSPGSVRVVRRNVLGEPRFKSSGHLPTTVDLV

SEQ ID NO: 271 - protein, 1101 aa, Actinomyces naeslundii
MWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 272 - protein, 1181 aa, Unknown
  Actinomyces sp. oral taxon 180 str. F0310
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 273 - protein, 1120 aa, Unknown
  Actinomyces sp. oral taxon 848 str. F0332
MNAMKQYNAGIDVGINSVGFAAIEVDSKGLPLNILNNMVVLHDSGVDPGTAKTGATRLANSGTARRTRKLIARRRKRLQKLDRYIEVQGWPLVDFSSLPDPYTPWKIRAKLTQDRLEGEEQGRGLSIALRHMARHRGWRNPYEGVESLHSPKEASKQFKDLKDRVTKVSGVIFDEDATPAEVVCDIGLSPKQRLRSAPSAKYKEGATLADEPVGGKSKEGLLGGKLMQSDNANELRKIGIVQGLSNEKVNEIIDQVFASESPKGQAGKRAKKDELPGQEQYVRALRAHLAFQRFRIVAAVANLRILEAEPKHERLLSQSEKDKVIEFLMSADGDDGVTWSDVAEELGIERECLSGTAKRGADGERPSSFPPTNSTNISIVRSKVKPLIEWWRKASDDEQATLVTALSNADELTDDQPSAETVRQFLSSPDEQSQEKIDKISLPKGRAAYSVNSLERLTRRMLKDSVDLFEARKREFGVDNNWTPTPDSIGEPVGNPAVDRVLKIVNRWLLAVTRKWGPPKVVNIEHVRVGFTSAAQTRKYEEENKTNRERNLAILEELRDKFGTSGKIRREDITRFAALRRQNCQCAYCGEAITFFDCEMDHIVPRKGPGSTNTRNNLVAICERCNKSKSNMPFSLWAQNCDIPGVSVEAVIDRVRTWIKDPELNPKQYNNFKKDVIERLRKTVDDDAIDNRSIESVAWMATELADRIGSHFRTAGANTKVRVYRGWLTSEARKASGFEGKINLIGGRGKTRLDRRHHAMDAATIALMRQSVAQTLVERASIRESDRLRRVVSSSWKDYRGADRDKQFSYGSWLNSMNALAELFNRAIDADGIPVTQNLRLRLGNGEAHDATIRSLEKKRVGASWTIGEIDRASTPQLWLALTRQEDFDQNDGLPANASRELRVKNHWFHAEENVTLFPTKSAAIAVRGGYAEIGNTIHHARLYKLPGKKLTYGMIRVFAIDLLCAWHTDLFSSPLLPESISLRTAETKVRRAVEDGAAMYIGWLVDGDEIVLDPETKAFKSNKIGEYLCEFPGTKRWKVDGFPDKEKLRLRPLQLAGEGLPEDVSAGTEEILGPKGNGWRVAINALFKSSQLVVVRRTALGMVRKLSRRHLPLTTRLRG

SEQ ID NO: 274 - protein, 1095 aa, Unknown
  Actinomyces sp. oral taxon 175 str. F0384
MPAHHLRVGIDVGTHSVGLATLRVDDQGTPIELLSALSHIHDSGIGKEGQKDHDTRKKLSGVARRTRHLLRNRRERLQQLDKVLVDLGFPIPKPEEYPDLSERTDPYRVWRVRARLVEETLPEELRGPAISMAVRHIARHRGWRNPYSKVESLLSPAEESSFMKALRKRIMTKTGEVLDDDITPGQAMAQVALTHKIYMRGPEGILGKLHQSDNANEIRKICARQGISSDVCKQLLRAVFKAESPRGSAVSRVAPDPLPGQGSFRRAPKCDPEFQRFRIISIVANLRISETKGENRPLTVDERRQVVAFLMEDSQADLTWVDVAEKLRVSRQALRGTAMLTADGERSAAQPPIDVTDQIMRKTKISALKTWWDKADAERRGAMVRYLYEGLEDSECAEVIAKLPEKDHAKLDSLHLPAGRAAYSRESLTALSDHMLETTNDLHEARKRLFGVDDSWAPPAEPVGAPVGNPSVDRTLKIVARYLSAVESIWGTPEVIHVEHVRDGFTSERTAEERDKANRSRHNDNQKAIEKIQHDYGKEGYISRGDIVRFHALKLQGSACLYCGTTIGYHTCQLDHIVPQAGPGSNNRRGNLVAVCERCNHSKSNTPFAVWAQKCGIPHVGVKEAISRVNGWVEHNHSTSSGDLTRLKKEVIARLRRTQKDPEIDERSMESVAWMANELHHRIAAAYPETTVMVYRGSITAAARKAASIESRINLIGEKGRKDRLDRRHHAVDASVVALMEPSVAKTLAERSSLRGEQRLTGQEQTWKQYTGLTVGARERFEAWRGHMHRLTELFNESLAADEVYVTQNIRLRLSDGSAHTVKASKLVSHRLGDGLTVQQIDRACTPALWCALTREIDFDEKNGLPAREDRVIRVHGQEISSADCIQVFSKRKKTKSDRDEAPFGAIAVRGGFVEIGSSIHHARIYRIEGEKPAYAMLRVFTHDLLSQRHGDLFSAVIPPQSISMRCAATELRQAISEGRATYLGWIVSGDELHIPVETFTTHKIGSFLKDYPNTTRWRICGYDSETMLILKPRILSAEGLNNSSDIAEYVIKNKGWRVAINKLAKVHPTVVRRDALGRPRHSSRSNLPVTWSIE

SEQ ID NO: 275 - protein, 1144 aa, Unknown
  Actinomyces sp. ICM47
MSMIDSSENVPGIRYRVGIDVGLKSIGFCAVEVDRNDQPVRMLNSMVFIHDAGVDPNENKAAKSRKLTAGVARRTRRLYRTRHQRLVNLDRVLSKEFGWPLPDLTSFKDPREPWHVRAGLLEGYIADDEKRKEALSIALRHIARHRGWRNPYAKVETLLQPSEPSDFLKGLNDRISEELGRAFPADATPGQLVDTYLAHPDYVGRAGTPKLRGPQGILAGKLHQSDNAQEIRGICDVQRIEPAERDRLIRVVFEAKSPKGSAKERGLVGYDELPGQGRHVRAEKAHPAFQLFRMVSVLANLRIREGREERPLTPDELEDLVDFINQVSLKQEVTWQDLADKLRIERADLRGTAKASFDGSPVLRNPPTDVTTEKIMACKVKWLKEWWKEADDEQRGYMVDAFSNSGGSEDGTDVNDEVAELLEQATEDDQLEFEKISLPQGRAAYSLDSLRRLTDRMLRDGVDLHTARRLEFNVGDDWKPAVEPIGAPTGNPAVDRVLKQVSRWLHAATERWGEPTVINIEHARDGLGSERVARELMRENEKRRKANASAVAEMAAKLKLSGKVHRSDQIRYFALQRQNCQCLYCGAPITYTTAEMDHIVPRADGSSTNDRSNLAAVCRTCNHMKGKIPFAVWASSDKANQGVSLTGALERVNMWQRDSGMSPRQLKQLQREVCARLKSKKPDQEFDGRSMESVAWMAVELRTRIEGFYRSRDEESVPSVGVYRGQLTAEARRASGFESRVNLIGGRGKTRFDRRHHAMDALVIALMNPSVSRTLALRLNMRDAQRLTGVEETWKHFYGKPGEASKRFESWRESMLRGVELFNIALSDNAIPFVENIRLRVGSSVIHDATVHSFCPPKTPDGKQIITKGYGEQHSLGSAMPVELIDRAETPALWTALTRCPDFDPKKGLPENPQRTISVNGTRVGPTELVNFFEFSKSGPKACLKVRGGYVDLSGAIHHARIYRIAGKKTAYAMIRVFQVDLLRLKDHDVFTTPLKPSTISMRTAEPKIREALANGTATQIGWLVEGDELVIDTSKYSGGFIGEVLARYPEATSWRVAGFMTPAKLRIKPILLSKEGFVDETQAALLGVEVTSEAIQKTVDRPGWLPAVNVLFGAGGVRVIRRNCLGEERYHSSASLPVSMTLE

SEQ ID NO: 276 - protein, 1103 aa, Unknown
  Actinomyces sp. oral taxon 181 str. F0379
MTKINDDLRYRVGIDVGLKSIGFCAVEVDENDQPLRLLNSMVFVHDAGVDPNENKAAKSRKLTAGVARRTQRGTAQNRRRLAELDRALSEELNWPLPNLEDFEDSYEPWHTRAELVEHYIKDDAERAEALAIAIRHIARHRGWRNPYLSVDSLLTPQEPSKFLRGLNERVTQALGREFPADATPGQLICAYIDSPKYAETQGIRGDSGILSGKLHQFDNVGEIRKICEVQRLDHDVFKLLVRKVFFAKSPRGSAAGLVGHDQIPGQGKYIRAEKAHPDFQLFRIVAVLTNLRIREGKAERCLTPDELRGLVDYILEVQLKQQVTWADLADNLGIERTDLRGTARASFDGSPALRFPPTDVTAEKIMASKVKWLKDWWDKADSERRGFMVDALSNSGGSTGDNDIDDEVAALLEAATEDEQAELEKIQLPQGRAAYSLDSLRRLTKRMLEEGVDLHTARKEEFNVDDDWRPEPEPIEAPVGNPAVDRVLKQVARWLNMATDRWGVPDVINIEHTRDGLGSEKVARELLRESQKRQDLNQKDMDKMIRELGISGKARRSSLIKYQAIQRQNSMCLYCGTEIGFETAEMDHIVPRALSGSTNDRSNLAAVCRACNHQKGAVPFAVWATSGEAHAGVSLEDAIKRVRLWQKGPGMSPKQHKAFQNEVISRLKSRKPDEEFDGRSMESVAWMAVELRTRIDGYYRKVNSDSVPKVGIYRGQLTAEARKASGFENRVNLIGGKGKTRFDRRHHAMDALVIAMMNQSVSQTLALRVNMRESQRITGQEETWKNFYGKPGQASERFEKWREGMLRAVELFNIELAKNAIPFHENVRLRVGSSKVHDDTVRKFIHAKLGEALSVAMIDCAETPALWTALTRLPDFDPKDGLPEDLSREIYIHSRKITADEQLNFFNSPSACLKVRGGYVEIGSSIHHARVYRIDGKKTTYSMVRVFATDLVKMTHEDVFTTPLKPSTISMRTADPKIRKALADGTATQIGWLVEGDELQLETDKYSGGLIGEVLAEYPQLTSWRVAGFYGVTQLRLRPYMLAAEGIPSDASESLRKVIEGKGWLPAINALLSSGCVKVVRRNCLGEPRFNAKSSLPVSQLLR

SEQ ID NO: 277 - protein, 1114 aa, Actinomyces turicensis
MQFHFYMVYVTMKGMNDKDASQQLRYRVGIDVGTHSIGFCAVEVDESGMPIQLLNSMVHKHDSGIDPGGNDTATTRLAEAGVARRTRRLIRRRKKRLQELDAFIEECGWPLVDLATITDARSPWRIRAHLATEHIDDEAEQGKLLSIALRHMARHRGWRSPYARISSLHIQADPSEQLKALAQRVSEKTGISLTADQTPAQLISVYLDVFETGKLRGPEGILGGKLMQSDNANELRRIATVQGLDNDLLKKIIGFVFAAESPKGSAAKRVGKDVLPGAHGLRAEKAHPAFQQFRIVSIVQNLRIKEGTGLRALTSEETEIVVDFLNQAGLTEAPTWEEVADNLEIPRSHLKGTATEGFDGIAPSTRPPFDVTSQKILNGKLKKLSAWWKDADYDHRCAMVNALSNVGSDDEGSLADDDVREFLSDFTDEELEALDKVELPGGRAAYSVDSLEKLTNTMLSEGCDLHSARKIAFGVDDSWTPPAEPIGQPVGNPAVDRVLKQVARWISAATNQWGTPESVNIEHVRDALGSEKASREYQRSLQTRRIRNEKLFAEMRERLDIGGKPRRSELTRYLALQRQNCQCLYCGMPITYTDAEMDHIVPRKGAASTNTRENFAAVCRACNHQKSNLPFAVWAEKTERPGVSVKEAYKRVSDMRIEPGMNGRQMNEFRKAIRLRLTTKHADAEIDGRSLESVAWMANELRHRIEGFYRSAENDVTVRVFRGAVTAEGRRASGFESRVNLIGGKGKTRLDRRHHAMDALTIALMEPGIAQTIALRMNMRESQRVLGEQETWKSFTGGSDTARKRWEHWCEEMLRASELFNVFLAEDRIPICQNKRLRLGSSAVHKAIVQPFEASDKRIVSDAMPVELIDRASTPALWTALTRDPDFDPKEGLPANPSRTIRLHDKRLGPNETVEFFPTAAACLAIRGGYCEIGAGIHHARIFRISGKKTTYAMLRVYQCDLVRFQKENLLTVELPANTISVRTAVPKLREALAHGTAEQIGWLVVGDELKIDLSGFTTGQIETFNETYPQATRWEVTGFPTKTQLRLKPLLIASEGLADDVPDDIVKIVKGPGWWPAIDKLLKIGNVVLYRRDTHGKPRVVSHRSLPLSSKLQ

SEQ ID NO: 278 - protein, 1113 aa, Unknown
  Alcanivorax sp. W11-5
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 279 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 280 - protein, 1552 aa, Unknown
  Anaerophaga sp. HS1
MFSQRNNPYCELLQNVKQLYKEKFGKTNQVDNSIIYGFMKRILGLDLGTNSIGWALVENDENDRKGKIIGMGSRIIPMDMSELDNFNKGASISKTAERTRLRMTRRLRERHLLRRARLHRILNIMGFLPEHYRNSIDFIDKKGCFFEGQEPKIAYKPDKNSEQFCFLFTSSFHEMLEDFRKFQPELIQNRKKVPYDWTIYYLRKKALTQKISKEELAWIILNFNTKRGYYHLRGEDEDNQDNKKIKEFRALKVVNVTEREGANSSGKKWYDMELENGWVYSRQSNLPPNLEGKTIELIVSYTLDNNGNIKKDKNGKEKYSLSMPGEEDWNLVKIKTENDLKTSKKSVGEYIYDHLLKNPDQKIRGKLISTIERKFYKEELSRILKTQMNFYEELKNRELYQKCVEELYPNNKSHQQTLLQKDFIHLIVEDIIFYQRPLKSKRAFVNNCPLEYRVYVDKKSGELIKSGVKCIPKSHPLFQEFRLWQYVRNLRIYERERMVNGRLMVNVDVTNELLPDEEHIVRLFDLLNDRKSFKQDDVLRFVGIKSPKDRKRYSWNYPEDKELPGNETRHLILAWLKKVDGVPEDWLDPEKLKALWHLLYSVTDREEIIKGLHSFAKKYELPDTFVEHFKKIPRLEREYGSFSEKAIKKLLPLMRMGKYWKAEEIPADLLEKAQKIIDAEADDRISDEVREKLLHLKDISQLKGLPLWQASYLVYGRHSETGEVVKWRTSEDLEKYILQFKQHSLRNPVVEQVILEALRVVKDIWEHYGEGKEGFFNEIHVEIGRELKNPADKRKKITSQIQENENTNLRIKALLEELFNDPSVKNVRPYSPAQQEILRIYEDGVLNGQKEIPDDILKISKMARPSKSQLVKYKLWLEQKYRSPYTGEIIPLSQLFTSAYEIEHIIPQARYFDDSFSNKVICEAEVNREKGHQLAFEFITKRGGDEIELNFGKKVTILNVEEYQKFVKDHYGRSLRSLSKMRKLLMEDIPDDFIDRQLNDSRYISKVVRNLLSNIVRAEDENSLVSKHLITCTGGVTTRLKHEWGLNDVWNELITPRFVRLNKMGKEKFGEWINKKGKQVFQIQMPLELQKGFNKKRIDHRHHALDALVVACASRSHVNYLNNDSARANASETRYDLRNKLCYKDKTDSNGNYRWKFYKPWESFTEEAKNRLAGTVVSFKSNRRIMTRSSNRYFKWVDTSEGKKKKLVRQIKGDNQAIRKPLHKDTVLGKVSLRKEKKVSLSKAIDLWESIVDKPLKKRIQSLREQGYDKKLLLKYFKDRNNQFNGQDISRVNIYFFDNNLAARRVTLDASFNSEKRIDGITDSGIKKILYAHLQNEKYHGKKDEKGNEISPYELAFSPEGLEEMNANIKKLNGGKPHCPIYKVRLAETIGEKFKLGEKGNKNKKYVEAAKGTNLFFAVYVDEKGVRSFETIPFSVALERRKQKLAVVPEENENKEKLLFYLSPNDLVYVPDEDEKLIDYRQLSINPTRIYKMVSSSGTQCFFIPHFVASPIVQTMELGPNNKSERAWDGQMIKNVCYKLSVDRLGNVKIEK

SEQ ID NO: 281 - protein, 1515 aa, Anaerophaga thermohalophila
MKRILGLDLGTNSIGWALVESDEEQKSGKIQGIGSRIIPMDQNELDNFNKGNTVSQTAERTRLRMVRRLRERHLLRRERLHRVLKEIGFLPEHYLEQIDFTEKPGGFLPGKEPKIAYKPDNFKDKYDFLFQDSYHEMLSDFQDKNPEFIQKRKKVPQDWTIYYLRKKALTAKITKEELAWIILNFNQKRGYYQLRGEDEDVAKNTKKEEFHALKVVKVKEREDSEGASGKWYDIELENGWVYPRQSNIRPDWEGKILELIVTYNLDKDGNIKTDKEGNEKRSFRMPNKDDWTLRKKRTENEIEKSGKTVGEYIYDNLLDAPDLKIRGKLVSTIERKYYRSELEQILTAQKKYHPELSNSELFNKCISNLYPNNDIHRKALLSKDFVHLIINDIIFYQRPLKSKRSTVSNCPLEYRVYVDKVTGEKKKVPLKCIPKSHPLYQEFRLWQYVKNLRLFEKERFENGRLLTNVDVTEQFLPDEDKYVELFEFLNGRKTFKQDDILKFAGIKSAKDRVKYYWNYPQEKEYPGNETRYLIESRLKKIENVPDEWLNYEKIEELWHLLYSVTDKVEIEKGLQSFAAKYQLPDLFVEVFKGFPRMEREYGAFSKKAIKKLLPLMRMGKYWKLENINPDLIEKVQKIIDGEADDNINDGIRERFSEINEMSDLRGMPLWKASYLVYGRHSEAAEVIRWRTSADLDQYIKDFKQHALRNPIVEQVVLEALRVVKDVWNYFGEGREKFFDEIHVEIGRDLKNPADKRQKIANQIQENENTNLRIKALLVELFNDPEVQNVRPYSPVQQQLLKIYEDGVLNAERDIPDDIQKISRMANPTRNQLIRYKLWLEQKYRSPYTGEIIPLNKLFTSEYEVEHIIPRARYFDDSFSNKIISEAEVNRKKDRMLAFEFIKKLGGSTIDLNYGKKVSVLTVEEYQQFVKDHYGINPHSRLKMQKLLMDEIPESFIERQLNDSRYISKMVRNLLSNIVREENENSPVAKQLITCSGSITNTLKQEWGLNDVWNTIITPRFERLNKMGEQKYGEWVNKEGKPVFQIQMPLELQKGFNKKRIDHRHHALDALIVASATRSHVNYLSNEAAKTNAKDTRFDLRNRLCYKEKRGQNRNFTWRFYKPWNTFTEDAKNALNDIVVSFKSNHRVINKSTNRYFKWENLPGGMKKKRLVRQEKGDNWAIRQSLHKDTVLGKVSLRKVKPVSLSVALDSWNNIVDKALKKKIRSLKDQGYDKKLMLKYFKDRRNEYNGENISRVNVYYFDEEMAARRVDLDTSFNSEKRIEGITDSGIKKIIYAHLKNEKYHGQKDDKGKDISPYELAFSPEGIAEMNANIKQLNGGKPHCPIYKVRLAEPVGEKFQLGETGNKTEKLVEVAKGTNLFFGVYANDEGVRSFATVPFYLAVEREKQGLPAVPQENENGDQLLFWLSPNDLVYVPSEEDAHFANPKQIELDNSRIYKMVSSTGTQCFFIPHFVATPIVQTIELGPNNKSERAWDGQMIKKVCYKLSVDRLGNVEIE

SEQ ID NO: 282 - protein, 333 aa, Bacillus cereus
MMNPNNFTKEDFWRTIILYGLNQATYKIALGQSLIRFSEQQRNVVSMNELAEDFFDMYLERLKNGKPQLATPNRQTAMERIINSYNIGRLTRSQAIEKVEREAFNDVIDRFHTVDSLQVPMKFYEKTDKGIVIFDNVFEIFSDNNNFELRNELDARWDLLESAFEIKRTDSQLVNDIRKLYLANGYERTDITKNRSVLNGYQSNVCFYCGELMSDDDVHVDHVIPRQLINHDDIWNLVLSHGFCNQQKSDNLPDVNYIEKLIERNEYFIKSNHPISNKLKERLGNTPRRRRTTIDRIYEHAKLVLAPWKGIYGYNPATDPFYKTFIRNIVLSK

SEQ ID NO: 283 - protein, 1068 aa, Bacillus cereus
MRYVLGLDIGIASCGWAVINQEKERIEDLGVRIFDKAENPKDGKSLAAPRRDARSTRRTLRRKKHRMQRIKILLVKQGLLFKTELNHLYESATEFDVWNLRLDALERKLHPKEFARVLIHLAKRRGFKSNRKETTLSENGQILESISENQQIMEQQNYRTVGEMILKDKKFENHKRNKDGTYIGTVTRQQLQDEIQMIFHTQRLYKNDYATEEFESSYLEIWASQRPYASKDQIEKMIGYCTLEPKEKRTPKASWSFQYFVALQTINNLRLISKDKIEELSFEEKKQIMNLALEKPIVKYIDIRKLLSIPNDFQFNSLSYSADTVDTTLENKRCIELKEYHSINKVYKQVYGKNTPNLLPIDYDTIAYGLTIFKDDKDILEYLQNKYVNAKGKPIKNLAKKTYDDTFIQALLNLNFTKMGHLSFKALKNIIPFLEEGLSYDKACEKAGYNFKGTSYTERTKYLPVIPQNTNPVVHRALSQTRKVINAIIKKYGSPNAIHIETARELSKTFQERKEIDSRYQDNSKKNEHAIHKLKELGNINPSGINIVKFKLWSEQDGRCMYSGKYIEPHRLFEEGYTEVDHILPYSRSLDDSYNNKILTLGTENQRKGNKTPYEYMGNTSIWDEFETRVQSNKKINFKKQQKLLLQNFSYAREQEFIERNLNDTRYATIYLTSLIQQHLIFSESSSKKKVRTVSGIITSHLRSRWGFNKDRKEGHIHHALDAVIVAVTSNHMIQRVTKYYKLKELNKNLQAKQLPFPEPWEGFRLELEARISPNTQQYLKGIHFKNYADVNLSDIKPIFVSRMPKRSITGELHQETIRKFLGYNEKGKVLTAIKTKLEDIPFDANGDFPMYGKETDLYTYNAIKERYLSHEKDKRKSFQEPLYKPTKSGEIGPLIKSIKIMDTRTIVNPVNQGKGVVYNSKIARTDVFKKEDKYYLIPIYTIDLLKNILPHKAITAGKGYEDWTTIDSSFTFLFSLFPNDLIQIVPSKNKTIKARTTVSKKEILLPSLTGYFKGVHSGTAGITVETHDGSVIANVGSKQLLLFEKYQVDVLGHYTKIKEEKRMGMAI

SEQ ID NO: 284 - protein, 1078 aa, Bacillus cereus
MRYVLGLDIGIASCGWAVINQEKERIEDLGVRIFDKAENPKDGKSLAAPRRDARSTRRTLRRKKHRMQRIKVLLVKHGLLSKTELDHLYESATEVDVWNLRLDALERKLYPKEFARILIHLAKRRGFKSNRKETTLSENGQILESISENQQIMEKQNYRTVGEMILKDKKFENHKRNKNGTYVGTVTRQQLQDEIQMIFHAQRLYKNDYATEEFESSYLEIWASQRPYASKDQIEKMIGYCTLEPKEKRAPKASWSFQYFVALQTINNLRLISKDRIEELSFEEKKQIMNLALEKSIVKYIDIRKLLSVPNEFQFNSLSYSADTVDTAVESRKCIELKEYHSINKVYKQIYGENALNLLPKYYDTIAYGLTIFKDDKDILEYLQNKYVNAKGKPISNFANKTYDDTFIQALLNLNFTKMGHLSFKALKNIIPFLEEGLSYDKACEKAGYNFKGTSYTEQTKYLPVIPQNTNPVVHRALSQTRKVINAIIKKYGSPNAIHIETARELSKTFQERKEIDSMYQDNSKKNEHAIHKLKELGNINPSGINIVKFKLWNEQDGRCMYSGKYIEPHRLFEEGYTEVDHILPYSRSLDDSYNNKTLTLGTENQRKGNKIPYEYMGNTSIWNDFETRVQSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGLRFKNYADVNLSEIKSIFVSRMPKHSITGELHQETIRKFIGYNEKGKVLTAIKTKLEDIPFDANGDFPMYGKESDLYTYNAIKERYLSHKKDKRKSFQEPLYKPTKSGGIGPLIKSIKIMDTRTIVNPVNQGKGVVYNSKIARTDVFKKEEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLIEKYQVDVLGNYTKIKEEKRIGLTTYNDNKKIAAC

SEQ ID NO: 285 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 286 - protein, 1069 aa, Bacillus thuringiensis
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLRVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 287 - protein, 206 aa, Bacteroides cellulosilyticus
MKKILGLDLGCNSIGWALVNEAENTEEISSIIKLGVRVNPLTVDEMQNFEKGKSITTNADRTLKRSMRRNLQRYKLRRDTLIEVLKEHGFITDSTLLSEHGNKTTFETYRLRAKAAVEEISLEKFARVLLMINKKRGYKSSRKAKGSEDGVLIDGMDVARKLYEEGLTPGELCLQILEAGKKNLPDFYRSDLQNEFDRIWNFQKLV

SEQ ID NO: 288 - protein, 349 aa, Bacteroides coprosuis
MKKILGLDIGTNSVGWAVVNTNQEGEPSQIEKLGSRIIPMSQDILDKFGQGQTVSSTASRTDYRGIRRLRERSLLRRERLHRVLHILDFLPKHYADSIGWDPRNSKTYGKFLPGTEVKLAWVPTADGHQFLFYSTYLEMLEDLKQTQAQLFETSQTPVPLDWTIYYLRKKALTQPITKHELAWLLLHFNTKRGYYQRRGELEDTPTDKLVEYHALKVVDVEVDPEDQSKKPWYFVHLENGWIYKRQSSEPLDNWKGLVKEFIVTTHLDKEGKPKLDKEGEVRRSFSSPKEDDWTLVKKKTENDLEKSGLTVGAYIYQTLLNKPNQKIRGGLIKHIERNYYVEELEQILR

SEQ ID NO: 289 - protein, 1504 aa, Bacteroides coprosuis
MKKVLGLDIGTNSVGWAVVNQNDKGEFLSIEKIGSRIIPMSQDVMDKFGAGQTESSTAQRTQYRGVRRLRERSLLRRERLHRVLHILHFLPQHYDAAIGWNKKENKTYGKFLPGVEVNIPWVATDQGHQFIFMDSYAEMLKDLKQHQPHLFEKSSTPVPLDWTIYYLRKKALTQAISKEELAWILLNFNQKRGYYQLRGEEVEDNTKREEFYALKVVKVELDKDNTSAKTWYKVHLENGFIYPCPSDTPIDSWVGMVKDFIVTTTLEKDGSEKRTADGEIKRSFRAPKEDDWTLLKKKTESELEKSGKQVGAFIYDTLLSNPDQKIIGGLIKTIERKYYKKELEQILETQQKFIAELSDKKLFQACAEELYPLNDSHRENLLERDFKHLFVQDIIFYHRPLKTKKSLISNCTYEYRTFYKNGEKQISPIKCIAKSNPLFQEFRVWQFVQNLRILQRQRSEGDSIKYNVDVTAEFLKDENDIANLFTWLNERKVIKQDQLLKSYFKLKVNKETKELDYRWNYVDDKNKEYPCNATRTHILSFLEKCKEEKRIEDDRFVYSLWHLLYSVVEPIELRGALAKFAEREHLHPSFVDVFAQFPPLEKEYGSYSEKAIKRLLPLMRMGDYWHEDKIDVKTKQRIQRIIDGEADDDITHRSREKVENLRSITDFKGLPLWKAGYVVYNRHSESGELTKWKTPHELSNYIQNEFKQYSLRNPIVEQIVLETLRVVHDLWVKHGDFSEIHLELGRDIKNSSDKRKRMAERQQENENSRQRVLEMLIDLKKEAAFADLNPYSPSQQEKLRIVEDGVLRSNIEIPKDIEKITKSAKPTSRELTKYRLWLDQKYRSPYTGQPISLAQLFTSKYEIEHVIPQAKYFDDSFTNKVICESEVNKEKGSMLAHEFILKNGGSTVNVGGRQVQVLKNDAYVELINRLYGKNNPVKAKKLLAEDIDEVVGDFSERQLNDTRYISRVVQKLLSNIVREEDEQESTSKHVIGCSGQVTTALKKDWGLNDIWNKIIQPRFERLNEMTATEDYGVWQSPNHFQIRVPEEIQKGFTKKRIDHRHHAMDALVIACATRSHINYISNRSGQDRNAKFETTRTDLRSKLCYKENSSGNNYNYIFNKPWDTFTQDAHRALENIVVSHKQNLRVLTKTNNYTQFINKDGKKDLQKQVKGDHFAVRKPMHQETIYGRVSIRSIKEVALKKALENWKQIVDRTLKDKIRELIGAYGKYDAQTILKYFKDRDYKFNNLKINRVEVYEYDHNCAAVRKSIGDDLTIKQIERITDESIRKILMNHLSNYDDNLKEAFSPEGLMEMNKNIKELNGGKNHQPIYKVRLFEDLGSKFPLGVSHNNPDKYAIAAKGTNLFFGIYEDQEGKRMFDSIPLNIVIDRLKEKKSPVPETYNESKLKFHLSPNDLVYVPTDEEQKQPELVDVDHLSDEQKGRVYKAVSFTGNRAFFVNHRVSKVIHDYVEFGTKNKIENDDDKRSLKHICWKLKVNRLGEITDVKR

SEQ ID NO: 290 - protein, 1509 aa, Bacteroides eggerthii
MKTILGLDLGTNSVGWAVINSVIKEQAERIWIEMAGSRIIPMDAAVLGDFDKGNSISQTSERTRLRGARRLRERQLLRRERLHKVLNILGFLPNHYLEYIDFEKHPGKFLADAEPKLAWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQVKEFIVTTDLNPDGTPKLDKYGEVKRSFRAPKEDDWMLIKKRTEADIANTHKTVGAYIYDTLLQKPQQKIIGKLVKTVERKLYRDELSLILQKQCAFHAELQDRALYARCVEALYPSNEVRRKNIANRDFVYLLMDDILFYQRPLKTKKSLIANCPYEENEYVDRETGEIKKTPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSSLEKANVCIDFLSNEKEVALWHILYSVSDKQEIEKALRTFAAKNGLDESFVEAFKKFPPFKSEYGAYSAKAIKKMLPLMRCGKYWDVSSIDDTTKERIKKIVTGEYDERISVKVRDKVMNLSDISCFRRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDTVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKLLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKNRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDTPAMIVDKRVKNKVFELLSYKYDKKRIEKYFKENAFLWKELDLAKVAVYYFTEATTEPLVAVRKPLDSTFNEKKIKESVTDTGIQKILLNHLCTKEGKPDLAFSAEGIEEMNRNLLQLNNGKSHQPIYKVRVYEPRGNKFSVGVLGNKGTKWVEAAKGTNLFFAIYITEDGKRTYETIPLNVVIEREKQGLVPVPDRNKKGDKLLFWLSPNDLVYLPTEEEREFGRINEPIDRGRIYKMVSCTGNEGHFIPANVANPIVPVIELGSNNKAQRAWTNEMIKDICIPIKVDRLGHIIEVKYRIDE

SEQ ID NO: 291 - protein, 1526 aa, Bacteroides faecis
MKKILGLDLGTNSIGWAVLNAADDNSLKYIEAAGSRIIPMDAAILGDFDRGNSISQTAERTRIRGMRHLRERYLLRRARLHRILNLLGFLPFHYAQDIDRYGNFSADMEPKIAWCKNLEGELEFIFIESFNEMLEDFRKNQPELVADNKKVPYDWVIYYLRKKALEKKISKEELAWILLNFNQKRGYYQLRGEDDDESMKTAKTRQYFDKQIIKNIIDTNQTYKGQRILIVELQNGDKGKIFKKEIPDWIGQEKNIIVTVDIDKDGNDKYEESGSLSCRFKIPTDAEWESEWKLIKMKTQKDLDESNKTVGTYIYDSILQNPTQKVRGKLVRTIERKYYKAELKQILEKQTEFHSELQDKDLYIECLNELYSNNDTHRNAITDRDFVYLFMNDILFYQRPLKSKKSLIDNCPYERNIYIDKETGEIKYSPIKCIAKSHPLFQEFRLWKFISSIRIYQRESVVEVVDKQLDLFSSQSTSVQKLVTDVDVTDKFLTCENDYVALFEWLNKKKIIDQKEFLKYRPFGLKGDIDNYRWNYVEDKSYPCNETHAMILTYFAKAGISEDILTKEMEEALWHILYSVEDRQEITKALRTFASKYHLSDSFVKVFSNIPPFKKEYGSYSAKAIKKLLSLMRMGKYWSEDAIDVNTRERIDKIVTGEYDEKIRDRVREKTIRLNDIRHFRALPDWLACYVVYDRHSETREITEWKSPEEIDEYIRNFKQHSLRNPIVEQVITETLRTVRDIWKQVGCIDEIHVELGREMKNPADKRKRITSQIIENENANLRVKALLTEFVNSEFEIENVRPYSLSQQDILRIYEDGVLNSVAEVPGDIAGILKKFNENDAKKRPTTSEILRYKLWLEQKYRSPYTGEMIPLSKLFTSAYEIEHVIPQSRYFDDSFSNKVICEAEVNKLKDNALGYEFIKKHHGEKVELGFGKIVEIFSVSVYEQFVKDNYSRNRGKMKKLLMDEIPEQFIERQLNDSRYISKVVKTLLSNVVREKAEQEAVSKNVIVCTGGVTDRLKKDWGINDVWNKIVLPRFLRLNELTNSTNFTAKNAAGNEIPAMPLELQKGFNKKRIDHRHHAMDAIVIACANRNIVNYLNNESASRKAKISRHDLQAILCDKVRTDDKGNYQWRVKKPWDTFTQDVYVALENIIVSFKQNLRVINKTSNYYWHYENGKKVLVKQVKGDSWAIRKPMHKDTVFGEVNLRKVKSVSLNEALKNPQFIVEKDLKRQLLSLLQQNFDIKKIKKYFEEHKDIWSDISLSKMNIYYFTKETKDRYFATRKPLDASFDKKKIESCITDTGIQQILLRHLELKENDPERAFSPDGIDEMNRNIIQLNKGKGHHPIAKVRVYEKADKFEVGQRGNKSSKFVEAAKGTNLFFAVYETEYPDEKTNSIVRKRNYATIPLNIAIERQKRGLSTAPEDEKGNVPSFVLSPNDLVYLPTSEDIVNGHITQPIDKSRIYKMVSSSGSQCFFIKHNIANIIVDKYEFSPLNKMERAISNEMIKEICIPVKVDRLGNIVKLGKSE

SEQ ID NO: 292 - protein, 1509 aa, Bacteroides fluxus
MKTILGLDLGTNSVGWAVINSVIKEQAERIWIEMAGSRIIPMDAAVLGDFDKGNSISQTSERTRLRGVRRLRERQLLRRERLHKVLNILGFLPNHYLEYIDFEKHPGKFLSDAEPKLPWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQIKEFIVTTDLNPDSTPKLDKYGEVKRSFRAPKEDDWMLIKKRTEADIANTHKTVGAYIYDTLLQKPQQKIIGKLVKTVERKLYRDELSLILQKQCAFHAELQDRTLYARCVEALYPNNEVQRRNIANRDFVYLLMDDVLFYQRPLKTKKSLIANCPYEENEYVDRETGEIKKAPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSRLEKANVCIDFLSNEKEVALWHILYSVSDKQEIEKALRTFAAKNGLDESFVEAFKKFPPFKSEYGAYSAKAIKKLLPLMRCGKYWDVSSIDDTTKERIKKIVAGEYDERIAVKVRDKVMNLSDISCFKRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDMVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKMLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKSRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDAPTMIVDKRVKNKVFELLSYKYDKKRIEKYFKENAVLWKELDLARVAVYYFTEATTEPLVAVRKPLDSTFNEKKIKESVTDTGIQKILLNHLCTKEGKPDLAFSAEGIEEMNRNLLQLNNGKRHQPIYKVRVYEPRGNKFSVGVLGNKGTKWVEAAKGTNLFFAIYITEDGKRTYETIPLNMVIEREKQGLAPVPDKNEKGDKLLFWLSPNDLVYLPTEEELEFGRINEPIDRGRIYKMVSSSGNQCFFIPQSISNAIIPTKELGANNKAERSWDGAMIKNICIPVKVDRLGRIIEVKYRINE

SEQ ID NO: 293 - protein, 1436 aa, Bacteroides fragilis; identical to SEQ ID NO: 155

SEQ ID NO: 294 - protein, 1512 aa, Bacteroides nordii
MKNILGLDLGTNSIGWAVINSEEDGPIVKKRIELAGSRIIPMDAAVLGNFDSGVTKSQTAERTSFRSIRRLRERQLLRRERLHKVLQILGFLPEHYVNDIDFENHPGKIKRNTEPKLPWRKNSMGQFEFIFQDSFEAMLTDFATHQPVFVSEGKKVPYDWTLYYLRKKALTEGISKEELAWLILNFNQKRGYYQLRGEEEEEQSNKLVEFYALRVVKVEATDDKKGKDTWYNVHLENGWIYRRTSNIPLDWEGKVKEFIVTTDLNEDGTPKLDKYGEVKRSFRAPKEDDWTLIKKKTESDIANSHKTVGCYIYDALLQNPHQKIKGRLVRTVERKFYKEELRLILEKQLSFHPELQDRDLYRACIDALYVSNEAHKNNISGRDFVYLFIDDIIFYQRPLKTKKSLIDNCPYEENQYMDRETGEVKQAPIKCIAKSHPLFQEFRLWQFISNIRIYQRERVLDDGKLETDVDVTPDFLKTEDDYTTLFEWFNDRKEVDQKAFLKNPQFGLKKTFTEYRWNYVEDKSYPCNETRNAILNGLQKAGVSADFLSREVEEALWHILYSVEDKIEIESALRKFASKHDLDDRFADVFKKLPPFKKEYGAYSAKAIKKLLPLMRIGKYWELSNIDDKTKERIDKIITGEWDENIHDRVREKAIKLSDITDFKGLPLWLSCYVVYNRHSEARAIAKWESPEDIDSYLRLFRQHSLRNPIVEQVITETLRTVRDIWKRVGQIDEIHVELGREIKNPADKRAKMTAQIVENENTNLRIKALLAEFINSEYEIENVRPYSSNQQEKLKIYEDTVLNGVKEIPEDINTILKKFRESDLKKRPTKSDFLHYKLWLEQKYCSPYTGRIIPLGKLFTSAYEIEHIIPQAHYFDDSFSNKVICEAEVNGLKDKKLGYEFIKHNPGKMVEIGFGKPPVRIFSVEEYERFVKENYSGIKNKMNKLLMDDIPETFIERQLNDSRYISKVVKSLLSNIVREKDSNGEYEPEAISKNVIVCTGSVTDRLKRDWGVNDVWNSIIYPRFERLNELTGSQQFGCWENKEGKRVFQTAVPLEMQKGFSKKRIDHRHHAMDAIVIACATRNHINYLSNESASKKAKISRTDLQRLLCTKCRTDDNGNYKWIVKKPWPAFTQDIRKALENITVSFKQNLRVINKTTNYYVHFDESGKKVLEKQINGDSWAIRKPMHKDTVFGKVNLQKVKEVRLSLALDTPKMIVDKKLKEKVLQLYSYKYDKKRIDKYFKENASLWKDLNLSKVAVYYFTNDSTEPLVAVRKPLDTSFNAKKIKESVTDTGIQKILLNHLSNNQDDPNLAFSPDGIDKMNKNLTALNDGKYHQPIYKVRVCEPQGNKFSVGTSGNKTSKYVEAAKGTNLFFAVYQTEDGKRSYETIPLNVVIEREKLGWTPVPENNNNGDKLLFWLSPNDLVYVPTADELNNGMRLDNMDKGRIYKMISCSGPQCFFIPQNVSNAIIPVIELGANNKAEKSWNNEMIKVVCVPIRVDRLGCITQINNQK

SEQ ID NO: 295 - protein, 779 aa, Bacteroides oleiciplenus
MKEGNQYDVACEYAGYRHSKSSLTREEIDNKVLKNRLEILPKNSLRNPVVEKILNQMVNVVNAVIDTYGKPDEIRVELARELKKGAKEREELAKSIAQNTREHEAIRQLLQTEFGMMHVTRNDIIRYKLYEELKDNGYKTLYSDQYIPREKVFSKEIDIEHIIPQARLFDDSLSNKTLEYRAVNIEKGNKTAYDFVKEKYGNDGLRRYLNHCEALFKDKKTKLKKLKMEDQDIPDGFIDRDLRNTQYIAKKALSMLSEISRRVVATTGSITDELRKDWQLVDIMKELNLPKYEALGFVETFKDKDGRIIKKIKDWSKRNDHRHHAMDALTVAFTKDVFIQYFNNKNAFWMSGSKEHANITAIKNKYFEKGKALAPIPLELFRTEAKHHLENILVSIKAKNKVVTNNINRTKKKNGENLKLQQTPRGQLHLESIYGSYRQCIIRDEKVNASFDASKIANVSKSAYRNALLKRLEAYDNDPKKAFTGKNSLDKNPVYLDENKMEKVPDRVKIVEFETVYTIRKPIDPKLSIDKVVDARIRTLLKKRLEEYGGDAQRAFSNIEENPIWLNKEKGISVKRVAIRGISNAQALHDKKDKDGNPILDKEGKGIPTDFVNTSNNHHVAIYRKPVVDKMGQVILDENGSPRYELGEDVISFFEAVARVNLRQPVVDKDYKRSEGWQFLFSMKQNEYFVFPNEKTGFNPKEIDLLNPENYALISPNLFRVQKIGLNDYTFRHHLETSIQNNSNELKFITWIRCGKNGINGVIKVRVNHIGQIVSMGEY

SEQ ID NO: 296 - protein, 653 aa, Bacteroides oleiciplenus
MKKILGLDLGSSSIGWALVNEGANDEEKSSIIKLGVRVNPLTVDEAQNFEKGKSITTNADRTLKRGMRRNLQRYKQRREALVEVLKKHEFITAGTLMSEQGNKTTFETYRLRAKAVEEEISLEEFARVLLMINKKRGYKSSRKAKGDEDGVLIDGMDVAKKLYDEDLNPGELCLQLLEAGKKTLPDFYRSDLQDEFDKIWNFQKQFNPESFCDTAKEEVRGKNRTQTWTILSKYFVWTEGDSVWNNEEARTEERIKEYKLVGIKRTTKGYEQKLENYRWRVQALSEQLNPEIIAIVLQEINGQISASSGYLGAISDRSKELFFNHQTVGQSLMSELDKNPNGSLRNKVFYRQDYLDEFNTIWEKQSLYHKELTVELKKEIRDIIIFYQRRLKSQKGLISTCEFEQREIIVEKDGKRKTKIIGCKVIPRSHPLFQEFKIWQTLNDVEVYVADRRTKRKQDRKSTTLFSDTEDILLVEGKRYLYQEEKELLAKELFVRENMKKAEVLKLLFEDPKELDLNFKQIDGNRTGFALFSAYSKMIEKYGYESVNFKNSADEIIEKLQIIFADLGWNTELFSIDLSKDDKELEKQPYFRLWHLLYSFEGDNTPTGNGKLIEALMRLCSVEKEYASVLANVSFQEDYGSLSAKAIKKYYLI

SEQ ID NO: 297 - protein, 1436 aa, Unknown
  Bacteroides sp. D2
MKRILGLDLGTNSIGWALVDEAENKDERSSIVKLGVRVNPLTVDELTNFEKGKSITTNADRTLKRGMRRNLQRYKLRRETLMEVLKEHKLITEDTILSENGNRTTFETYRLRAKAATEKISLEEFARVLLMINKKRGYKSCRKAKGAEEGTLIDGMDIARELYNNNLTPGELCLQLLDAGKKYLPDFYRSDLQNELDRIWEKQKEYYPEILTEVLKEELRGKKRDAVWAICAKSFVWEEYYTEWNKEKGKTEQQEREHKLEGIYSKRKRDEAKRENLQWRVNGLKEKLSLEQLVIVLQEMNIQINNSSGYLGAISDRSKELYFNKQTVGQYQMEMLDKNPNASLRNMVFYRQDYLDEFNTLWEKQAEYHKELTGELKKEIRDIVIFYQRRLKSQKGLVGFCEFESRQIEVEIDGKKKIKTVGNRVIPRSSPLFQEFKIWQILNNIEVTVVGKKGKRRKQKDNSPTLFDGLDDTEQLELNGSRYLYQEEKELLAQELFVRDKMTKSDVLKLLFDNPQELDLNFKTIDGNKTGYTLFQAYSKMIEMSGHEPVDFKKTVEKVVEHVKAVFDLLNWNTDILGFNSNEELDNQSYYKLWHLLYSFEGDNTPTGNARLVQKITELYGFEKEYAIILANVTFQDDYGSLSAKAIHKILPHLKEGNRYDVACAYAGYKHSESSLTKEEIANKALKDRLTLLPKNNLRNPVVEKILNQMVNVINAIIDTYGKPDEIRVELARELKKNAKEREELTKFIAETTRKHEEFKILLQSEFGLTNVSRTDILRYKLYKELESCGYKTLYSNTYIPREKLFSKEFDIEHIIPQARLFDDSFSNKTLEARSINLEKGNKTAYDFVKEKFGESGADNSLDHYLNNIEDLFKSGKISKTKYNKLKMAEQDIPDGFINRDLRNTQYIAKKALSMLNEISRRVVATSGTITDKLRQDWQLVDVMKELNWEKYKALGLVEYFEDKDGRQIGRIKDWTKRNDHRHHAMDALTVAFTKDIFIQYFNNKNASLNSNTNEYAIKNKYFQNGRAIAPIPLREFRVEAKKHLENTLISIKAKNKVVTGNINKTKKRGGVNKYLQQTPRGQLHLETIYGSGKQYLTKEEKVNASFDMKKIATVSKSAYRDVLLKRLHENDNDPKKAFTGKNSLDKQPIWLDKEQTRKVPEKVKTVTLETIYTVRKEISPDLKVDKVIDAGVRKILTGRLNEYGNDAKKAFSNLDENPIWLNKEKGISIKRVTISGISNAQSLHVKKDKDGKPILDEDSRNIPVDFVNTGNNHHVAVYRRPVIDKRGQLVIDEAGNPKYELEEVVVSFFEAVTRANLGQPIIDKDYKTSEGWQFLFSMKQNEYFVFPNEKTGFNPKEIDLLDAENYGVISPNLFRVQKFAHKNYVFRHHLETTIKDTSSILKGITWIDFRSSKGLDAIVKVRVNHIGQIVSVGEY

SEQ ID NO: 298 - protein, 1510 aa, Unknown
  Bacteroides sp. D2
MKRILGLDLGTNSIGWALVDSEEQRILGMGSRIIPMDQGVLDTFSGGNPVETQTAARTAYRGTRRLRERALLRRERLIRVLNMMKFLPEHYASQIDFEKRLGQFFDEKEPKLAWKQNDEGRFEFIFQQSFNEMIEEFKNKGVVREDKKIPYDWTIYYLRKKALSQEIEKEELAWILLNFNQKRGYYQLRGEEEEENPNKLVEYYSLKIVDVIADEKPNSKGDIWYSLHLENGWIYRRSSKIPLFGWKDKTRDFIVTTDLNDDGTVKKDKEGIEKRSFRAPSENDWVLLKKKTESDIEKSHKTVGAYVYETLLQNPMQKVRGKLVRTIERKFYKDELKQILEKQREFHPELRDEDLYNDCVRELYRSNETYQFILSKRDFVHLFLDDILFYQRPLRSQKSAIGDCILEFKTYKDKDGNNIKEYLKVISKSNPLYQEFRIWQWLYNLKIYRKEDDEDVTLQFIANIEDKEQLFDFLSNRKSIEQKPLLEYLIKAKGLKKQVKTEAYRWNYVEDKIYPCSETKTMISTRLAKVENIPDNFFTKEIEQKLWHIIYSVTDKNEFEKALRTFAKKYDLDIASFVDNFKKIPPFKNEYGSFSEKAIKKLLPLMRLGKYWKWNDIDNNTQNRISKIITGEYDEEIKDIVREKSIALTNENDFQGLQLWLAQYLVYGRHSEADIAGKWHSVADLEKYLNEFKQHSLRNPIVEQIITETLRVVRDIWRKYGQGAENFFSEIHVELGRDMKNTADERKKIVNVVTENENTNLRIKALLMELKNNSDGKLEVENVRPYSPTQQDILKIYEEYAISTGLDNEKDEKVKEDIKKISRVAQPTTTELQRYKLWLEQKYCSPYTGKVIPLGKLFTEEYQIEHIIPKSRYYDDSFSNKVICEAAVNKLKDKCLGLEFIKNYHGQIVETGFGQKVTIFDEEAYQNFVKQHYAYNRSKRTKLLLEEIPEKMIERQMNDTRYISKFVLPLLSNLVRAEENDNGVNSKNVLPVNGKITTMLKQDWGLNDVWNDLILPRFVRMNELAKTIAFTSWNEQHQKYLPTVPLELSKGFQKKRIDHRHHAMDALVIACATRDHVNLLNNKHANTDTIRYDLQRKLRLFERVTYIDPQTKNNVTKDIPKEFKKPWDNFTVDARNELEKIIVSFKQNLRIINKATNIYTKYENGKKIKVGQKGLNWAIRKPLHKETVFAKVSLRKRKTVRLSEALKDWKKIVDKKLKQEIKRLTCQYGKFDVDTILRYFKDRKYQFGEVDVSKVKMYYFDEENAAVRKNVDTSFTEKFIQGSVTDTGIQKILLNHLEAKGNKVEIAFSPEGIEEMNKNIIQLNEGKLHLPIFKVRVYETIGNKFSVGVKGNKKDKYVEAAKGTNLFFAIYVDENGIRSYETIPLNIVIERLKQGLSVVPEKNRKEHSLLFYLSPNDLVYVPIEDERENIHAVNLDQLNNEQRKRIYKMVSCTGSECHFVPYYVASPIVNKVEYSSLNKIGRSLTGEMIKDVCIKLKVDRLGNVKGISGL

SEQ ID NO: 299 - protein, 1436 aa, Unknown
  Bacteroides sp. 2_1_16
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKETYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSAIFEELNDAEQLELNGSRRLCQEEKELLAQELFVRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKANEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIETVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKIGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 300 - protein, 1424 aa, Unknown
  Bacteroides sp. 3_1_19
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYHSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 301 - protein, 1055 aa, Unknown
  Bacteroides sp. 3_1_33FAA
MRIYRKDLAQDVDVTNELLKTEEDYVALFDWLNGKKEIDQKAFLKYPLFGLKKEVENYRWNYVQDKPYPCNETRSSMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERMDKIITGEYDEKIENRVREKAIHLADVSDFKGLPLWLVCYIVYGRHSEAKEITQWKSPADIDLYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVARQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNHFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKVRWYEQADKFAVGQTGNKSSKFVEAAKGTNLFFAVYESNILDKKTNTIIKKRNYATIPLNVAIERQKQGLPVAPEDENGNDPIFVLSPNDLVYLPTAADLANGIIAQPLDRGRIYKMVSCTGNEGYFIPARIANPILQTIELGSNNKAQKAWTDEMIKEICMPIKVDRLGNVLESSSSYKK

SEQ ID NO: 302 - protein, 1055 aa, Unknown
  Bacteroides sp. 9_1_42FAA
MRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 303 - protein, 286 aa, Bacteroides uniformis
MLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 304 - protein, 1508 aa, Bacteroides uniformis
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKVKVVRLSVALDTPSMIVNKRVKNKVLELLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 305 - protein, 1210 aa, Bacteroides uniformis
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKALIPQHYNLTLFISS

SEQ ID NO: 306 - protein, 1504 aa, Bacteroides vulgatus
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEEENKNKLVEFYALKVVAVEDSGEKKGKDIWYNVHLENGWVYRRTSNMPLDWVGKTKEFIVTTDLEKDGTPKKDKEGNVKRSFRAPKEDDWSLLKKKTEADIDQTHKTVGVYIYDTLLGNPSQKIRGRLVRTIERKYYKEELKQILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIVNLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEITQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSCTGNEGHFIPARIANPILQTIELGSNNKAQKAWTDEMIKEICMPIKVDRLGNVLESSSSYKK

SEQ ID NO: 307 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 308 - protein, 1352 aa, Belliella baltica
MKKILGLDLGTTSIGWAFIKEPEKDVVGSEIVDMGVRIVPLSSDEENDFAKGNTISINADRTLKRGARRNLQRFKQRRNALLEIFKEKKLISTNFKYAEDGPSSTFSTLNLRAKAAKEKIELQDLVKVLLQINKKRGYKSSRKAKSEEDDGSAIDSMGIAKELYENDLTPGQWVYEALQKGRKNVPDFYRSDLQEEFKKIVNYQSEFFPDIFNASFVEDWMGKASTPTKQYFNKKGVQLAENKGKREERRLQEYKWRAEAVNFKIDLSEIALILSQINSQISNSSGYLGAISDRSKELYFKNLTVGQYLYQQIKKNPHTRLKGQVFYRQDYLDEFERIWSVQSSFYPQLNDALKREVRDITIFFQRRLKSQKHLISNCEFEDHHKVVPKSHPVFQEFRIWQNLNNLLLIKKDNLNEKFDLELESKIALANELAFKRELNVKDALKILGLKPNEWEFNFTKIEGNRTNQAFFDAFAKIIELEDGEPIDLGDLKADDILDQFSEAFLRIGIDTELLQVNSDIEGAEYEKQSYIQFWHLLYSSEDDQKLKLNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPELGRPDEIRVEMARELKANAEQRKNMTSNIASATRDHDKYREILKSEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEISRRVSVTTGTITDKLREDWGLVEIMKELNWEKYDKLGLTYTIEGKHGERLNKIKDWSKRNDHRHHAMDALTVALTKPAYIQYLNNLNAKGLNNKKGTEVFAIEQKYLKRENGKLCFIPPIENIRSEAKKHLSRILVSYKAKNKVVTINKNKTKSKAGLNEQIALTPRGQLHKETVYGKSFHYSTKFEKIGASFNVQKINTVAKKEEREALLKRLAENGNDPKKAFTGKNTLNKMPIYLDLGKNIKLSEKVKTVVLEQNYTIRKNIDPDLKVDKVIDVGIKRILESRLEEFGGNAKLAFSNLEENPIWLNKEKGISIKRVKISGVSNVESLHVKKDHFGEPILDQEGNEIPVDFVSTGNNHHVAIYEDENGNLQEEVVSFFEAVVRQNQGLPIIKKNHTLGWKFLFTLKQNEYFVFPSDDFVPADVDLMDEQNYHLISPNLFRVQKIARKNYVFNNHLETKAVDNDLLKSKKELSKITYHFYQTPEHLRGIIKIRINHLGKIIQIGEY

SEQ ID NO: 309 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 310 - protein, 1430 aa, Bergeyella zoohelcum
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVITDWTKRNDHRHHAMDALTVAFTKHNHIQYLNYLNARKNEKHKEHSNIMGIQQLETIKVTDKNGNEKRVFKAPMPNFRQVTKAFLENILISHKAKNKVVTKNKNKVAGSNKVQEVLTPRGQLHKETVYGKYQYYVQKEEKIGAKFDLETIKKVANPLYQSLLKKRLEENGGDPKKAFTGKNSLAKNPIYLDDTQTEQLPEKVKLVWLENSFSIRKDITPENFKDEKLIDKILDEGVKRILKERLQSFGNDAKKAFSDLDKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQKFSKLQYGNSFVREFVFRHHLETTVEDRKELQGITYKQMKNSTFFNDIIKVRINHLGDIVSIGEY

SEQ ID NO: 311 - protein, 1281 aa, Bifidobacterium bifidum
MEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLAFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 312 - protein, 1121 aa, Bifidobacterium dentium
MSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 313 - protein, 354 aa, Bifidobacterium longum
AKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWV

SEQ ID NO: 314 - protein, 1124 aa, Bifidobacterium longum
LTGHSGHTFWPTSSSPPIQLEQEKRPLPQRNTSQNGHTFWPITRERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFPVSMLMVRLASIYNSSRSLVEGTLHGNIGLLMDSLTRRS

SEQ ID NO: 315 - protein, 166 aa, Bifidobacterium longum
MGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPA

SEQ ID NO: 316 - protein, 1138 aa, Bifidobacterium longum
MNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 317 - protein, 182 aa, Bifidobacterium longum
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPA

SEQ ID NO: 318 - protein, 441 aa, Bifidobacterium longum
MVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRM

SEQ ID NO: 319 - protein, 967 aa, Bifidobacterium longum
MVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 320 - protein, 1151 aa, Unknown
  Bifidobacterium sp. 12_1_47BFAA
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 321 - protein, 1092 aa, Brevibacillus laterosporus
MAYTMGIDVGIASCGWAIVDLERQRIIDIGVRTFEKAENPKNGEALAVPRREARSSRRRLRRKKHRIERLKYMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRASLLVEIHTLFESQRQHHNFLASKDFELEYINIWSSQRPVATKDQIEKMIGTCTFLPKEKRAPKASWHFQYFMLLQTINHIRITNAQGTRPLNKEEIEQVVNMALTKSKVSYHDIRKVLDLSEEYQFVGLDYGKEDEKKKVESKETIIKLDDYHKLNKIFNEVELAKGETWEAVDYDTVAYALTFFKDDEDIRDYLQNKYKDSKNRLVKNVANKEYTNELIEKVSTLSFRKVGHLSLKALRKIIPFLEQGMTYDKACQAAGFNFQGISKKKRSVVLPVIDQISNPVVNRALTQTRKVINALIKKYGSPETIHIETARELSKRFDERKNITKDYKENRDKNERAKKHLSELGIINPTGLDIVKYKLWCEQQGRCMYSNQPISFERLRESGYTEVDHIIPYSRSMNDSYNNRVLVMTRENREKSNQTPYEYMGNDTQRWDEFEQRVTTNPQIKKEKRQNLLLKGFTNRRELEMLERNLNDTRHITKYLSHFISTNLEFSPSDKKKKVVNTSGRITSHLRSRWGLEKNREQNDLHHAMDAVVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNAKKAFSTDLHKPKKDGTKGPLIKSVRIMENKTLVHPVNKGKGVVYNSSIVRTDVFQRKEKYYLLPVYVTDVTKGKLPNKVIAAKKGYDDWIEVDDSFTFLYSLYPNDLIFIRQNPKKKISLKKRIESHSISDSKEVQEILTYYKGVDSSTAAIEFITHDGSYYAKGVGVQNLDCFEKYQVDILGNYSKVKGEKRLELETSDNNHKGKDVNSIKSTSR

SEQ ID NO: 322 - protein, 103 aa, Butyrivibrio fibrisolvens
MISVGQSRKDLEDLGYEFKLSFYKEDIIEYEKNGDILVERFLSRTMPQVRNYIETKPIDRPKYDKRNPVGLSKTSSIRKITMDILGNRFYVDKMSFNNVVGTQ

SEQ ID NO: 323 - protein, 177 aa, Butyrivibrio fibrisolvens
MLIAFSQMGYDAYHELTNKYIDFETGEIIDKEGFNELLNNDLVYKNTMYESKWLKIKGNIEKAAEKNKYWYQVNKKCNRGLCNQTVYGTRESDGDVYKISKIDIRTDDGFKKFKNIVDKGNESVFLMYENDPKTFELIMDIYKNYSDSKNPFVQYEKETGDIIRKYSKKITGQRFLN

SEQ ID NO: 324 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 325 - protein, 984 aa, Campylobacter coli
MARILAFDIGISSIGWAFSENDELKDCGVRIFTKAENPKTGESLALPRRLARSARKCLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 326 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 327 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 328 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 329 - protein, 987 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 330 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 331 - protein, 987 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 332 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLTNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 333 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 334 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVVLSSGMITQMLRNFWYLGFKNHKNYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANTKGSLVRTDLFVDKENKFHAVSIYKADFSTKKLPNKTPATTSNGETKEGIEMNENYNFCMSLYKNTPVSVKIKGMKEPIICYYHGFNTSGSKITYKKHDNNYHNLSEDEMVVFRKNDKESIVVGKILEIKKYSISPSGELSLIENEKRKWF

SEQ ID NO: 335 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKILTFKKLNDLKQGKTPFEAFGEDEKLWAEINERIKEYNGKKRFKIFDKFFKDKKPFDFTEQTLQDTRWLTKLVASYLNEYLLFLPINEDENTALGYGEKGSKQHVVLSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 336 - protein, 933 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSVIILHIAKHRGYDDSALKNENGTIIEALNKNKETMLKFKSVGEYFYKNFVQNKEVKKIRNTTEDYSNSVPRSLLKQELDLILDRQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEHLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANANGSLVRSDLFIDKKNKFHAVPIYKADFSTKKLPNKTPATTSNGETKEGIEMNENYNFCMSLYKNTPISVKIKGMKESIICYYHGFNTSGSKITYKKHDNNYHNLSEDEMVVFRKNDKE

SEQ ID NO: 337 - protein, 666 aa, Campylobacter jejuni
KGEKGTYFIEFKKYKEFIKALDEHSLSQDDLNEIAKDITLIKDEIKLKKALAKYDLKENQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFAKQNQEKLNKTPFEAFGNDSTKWQKIEVLTKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDEDYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 338 - protein, 190 aa, Campylobacter jejuni
MAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKKVMNAA

SEQ ID NO: 339 - protein, 985 aa, Campylobacter jejuni
MAKILAFDIGISSIGWAFVENDELKDCGVRIFTKAENPKTGESLALPRRLARSARKRLARRKARLNHLKHLIANEFKLNYEDYQSFDESLAKAYKGTLISPYELRFKALNELLSKQDLARVILHIAKRRGYDNIKNSDDKEKGAILKAVKENEEKLANYKSVGEYLYKEYFQKFKENSKEFINVRNKKESYERCIAQSFLKDELKLIFQKQREFGFNFSKKFEEEVLSVAFYKRALKDFSHLVGNCSFFVDEKRAPKNSPLAFEFVALTRIVNLLNNLNKNNSYIKDDLNALLSEVLKNGTLTYKQTKKILGLSDDYEFKGQKGNYFIEFKKYKEFIKALCEHNLNQDDLNEIAKDITLVKDETKLKKALAKYDLNQNQIENLSKIEFKDHLNISFKALKLIVPLMREGKKYDEVCNELNLKTAINEDKKEFLPAFNETYYKDEVNNPVVLRAIKEYRKVLNSLLKKYGKVHKINIELAREVGKNHRERSKIEKEQNENFKAKKDAELECEKLGLKINSKNILKLRLFKEQKEFCVYSGEKIKISDLQDEKMLEIDHIYPYSRSFDDSYMNKVLVFTKQNQEKLNKTPFEAFGKDDVKWQKIETLAKNLPAKKQKRILDKNYKDKEQKDFKDRNLNDTRYIARLVLNYTKDYLEFLPLSDDENIKLNDTQKGSKVHVEAKSGMLTSVLRHTWGFSTKDRNNHLHHAIDAVIIAYANASVVKAFSDFKKEQENYTAELYAKKINELDFKNKRKFFEPFSNFRQKVLEKIDEIFVSKPERKKPSGALHEETFYKEEEFYKEYGGKEGVLKALELGKIRKVNGKIVSNANMFRVDIFKYKKTNKFYAVPIYTMDFALGILPNKAVVGGKDKQGIIKDWLLMDENYEFCFSLYKDSLILLQTKDMQEPELVYFKSFKSSTAGLVVSKHDNKFENLNENQKKLFKSANEKKVVAEGIGIQNLKVFEKYIVSALGEITKAEIKERENFKKK

SEQ ID NO: 340 - protein, 987 aa, Campylobacter jejuni
MARILAFDIGISSIGWAFSENDELKDCGVRIFTKAENPKTGESLALPRCLARSARKRLARRKARLNHLKHLIANEFKLNYEDYQSFDESLAKAYKGSLISPYELRFRALNELLSKQDFARVILHIAKRRGYDDIKNNGDEEKGEILKAIKQNEEKLVSYQSVGEYLYKEYFQKFKENSKEFINVRNKKESYERCIAQSFLKDELKLIFQKQRKFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKIVSNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 341 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDEGLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 342 - protein, 961 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNIGFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKLSDLQDEKMLEIDHIYPYSRSFDDSYMNKVLVFTKQNQEKLNKTPFEAFGNDNVKWQKIEVLAKNLPEKKQKRILDKNYKDKEQKDFKDRNLNDTRYIARLVLNYTKDYLDFLPLSDDENTKLKGSKVHVEAKSGMLTSALRHTWGFSTKDRNNHLHHAIDAAIIAYANNSIVKDFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNLKVFEKYIVSALGEVTKAEFRQREDFKNELR

SEQ ID NO: 343 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 344 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVSYQSVGEYLYKEYFQKFKENSKEFINVRNKKESYERCIAQSFLKDELKLIFQKQREFGFSFSKKFEEEVLSVAFYKRALKDFSHLVGNCSFLLMKKERQKNSPLAFMFVALTRIINLLNNLKNTEGILYTKDDLNTLLNEALKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKMVKNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 345 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYPVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 346 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFHQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 347 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 348 - protein, 861 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFLCCANLYYGFCFKSITK

SEQ ID NO: 349 - protein, 462 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKS

SEQ ID NO: 350 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALDEHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNKTPFEAFGNDGVKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLVVSKHDNKFETLSKNQKILFKNANEKEVIAKSIGIQNLKVFEKYIVSALGEVTKAEFRQREDFKK

SEQ ID NO: 351 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 352 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGLKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 353 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHTIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 354 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTFLNEVLKNGTLTYKQTKKLLGLSDDYEFKGEKGTYFIEFKKYKEFIKALGDHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 355 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKSLGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 356 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALVKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 357 - protein, 983 aa, Campylobacter jejuni; identical to SEQ ID NO: 231

SEQ ID NO: 358 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLVNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSEKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 359 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDNIKNSDNEEKSEILKAIKQNEEKLVNYQSVGEYLYKEYFQKFKENSKEFINVRNKKESYERCIAQSFLKDELKLIFQKQREFGLSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVVINEDKKDFLPAFNETYYKDEVTNPVVLRAIKEYRKVLNALLKKYGKVHKINIELAREVGKNHSQRAKIEKEQNENYKAKKDAELECEKLGLKINNKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPTKKQKRILDKNYKDKEQKDFKDRNLNDTRYIARLVLNYTKDYLDFLPLSDDENTKLNDIQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 360 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAEFECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 361 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGTILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 362 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFNESLAKAYKGSLISPYELRFRALNELLSKQDFARVILHIAKRRGYDDIKNSDDKEKGAILKVIKQNEEKLANYQSVGEYLYKEYFQKFKENSKEFTNVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 363 - protein, 984 aa, Campylobacter jejuni
MARILAFDIGISSIGWAFSENDELKDCGVRIFTKAENPKTGESLALPRRLARSARKRLARRKARLNRLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLNQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 364 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFLKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 365 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 366 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 367 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVTLTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 368 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFIQREDFKK

SEQ ID NO: 369 - protein, 987 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRVPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYGVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 370 - protein, 984 aa, Campylobacter jejuni
MARILAFDIGISSIGWAFSENDELKDCGVRIFTKVENPKTGESLALPRRLARSARKRLARRKVRLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 371 - protein, 721 aa, Campylobacter jejuni
MFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNNTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 372 - protein, 512 aa, Campylobacter jejuni
MHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 373 - protein, 965 aa, Campylobacter jejuni
MKIIGFNLGIANIGWALRENDEIIDCGVRVFDIPENPKNGNSLALERRENKARMKIVKRKKARMLATKTFLKKELNVDLSKLFLIGSTQSIYELRAKALSSLISKEELSAIILHIAKHRGYDDSALKNENGTIIEALNKNKETMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQEINFKGLDYSKNNVENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKSEYLPLFEKTRFAKDISSPVVIRAICEFRKLLNDIIRRYGSVHKIHLELTRDFGISFSDRKKIIKEIEQNEQSRIKALETIKELKLEETSKNIQIVRLFEDQKGICPYSGLKMDLNRLDELVIDYIRPYNRSLDDSYSNKVLTFKKLSDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHDLTPLKIKELKNTYGDLDLAVKLGKIRKYNDKYYANANGSLVRADLFVDKKNKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIAVGKILEIKKYSISPSGELSLIENEERKWF

SEQ ID NO: 374 - protein, 759 aa, Campylobacter jejuni
MLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFESFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 375 - protein, 984 aa, Campylobacter jejuni
MVRILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 376 - protein, 1003 aa, Campylobacter lari
MRILGFDIGINSIGWAFVENDELKDCGVRIFTKAENPKNKESLALPRRNARSSRRRLKRRKARLIAIKRILAKELKLNYKDYVAADGELPKAYEGSLASVYELRYKALTQNLETKDLARVILHIAKHRGYMNKNEKKSNDAKKGKILSALKNNALKLENYQSVGEYFYKEFFQKYKKNTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEVLNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYDEACEIANLKPKTVDEKKDFLPAFCDSIFAHELSNPVVNRAISEYRKVLNALLKKYGKVHKIHLELARDVGLSKKAREKIEKEQKENQAVNAWALKECENIGLKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQEDFISRNLNDTRYIATLIAKYTKEYLNFLLLSENENANLKSGEKGSKIHVQTISGMLTSVLRHTWGFDKKDRNNHLHHALDAIIVAYSTNSIIKAFSDFRKNQELLKARFYAKELTSDNYKHQVKFFEPFKSFREKILSKIDEIFVSKPPRKRARRALHKDTFHSENKIIDKCSYNSKEGLQIALSCGRVRKIGTKYVENDTIVRVDIFKKQNKFYAIPIYAMDFALGILPNKIVITGKDKNNNPKQWQTIDESYEFCFSLYKNDLILLQKKNMQEPEFAYYNDFSISTSSICVEKHDNKFENLTSNQKLLFSNAKEGSVKVESLGIQNLKVFEKYIITPLGDKIKADFQPRENISLKTSKKYGLR

SEQ ID NO: 377 - protein, 372 aa, candidate division
DNESAINQIAYILTTQKADEGIRAELDSLPLSDKAKKAIVKIKPTNFKAFGHLSIKALQKITPHILEGMTYDKACEAAGYDFKKQSASLEQITNPVVKRAITQTLKVVRAIERKYGKPYFIKVETARDLAKNFKDRNAIKKENEENQGYNEDIKSIITNGYEASPKTKGGKQLLNHLKEFNVRLNKNADFNGQQIIKVKLYREQQGKCLYSGNPIDFETMLRDDNAYQVDHIVPFSRSNNDGITNKVLVFTEENQKKADRTPFEYFGTDERRWEKFVALVETTYKTRDVKTSDKATNAINYEYNGYAMKKKQNLLLQDYKNDSWNVRALNDTRYITRFIQNYLRQNVDFAEGEEKQRIIAPNGTTTAYLRKR

SEQ ID NO: 378 - protein, 1117 aa, Capnocytophaga ochracea
MKHILGLDLGSNSIGWAFVQQDFENKQGKIIATGSRIIPMDQGILGDFERGNTVSQTAERTTYRSMRRLRERHLLRRERLHRVLHLLGFLPPHYDAQIDFTKRYGKFIDNAEPKIAYNNGNFIFMNSFNEMVEDFKKHQPQLFYKKSNGEESRIPYDWTIYYLRKKALSQKITQQELAWLILHFNQKRGYYQLRGEEETENPNKEVAFHSLKVVDVEAEAPNKKGEIWYTIRLENGWIYRRTSKNPLDDWKGKTRDFIVTTDLNDDGTIKLDKEGKEKRSFRAPDENDWNLLKKKTEHDIDFSGKPVGTYIYDHLLQNPNQKIKGKLVRTIERKYYKDELKAILAKQIALQPELFTETLLADCIRELYRKNETQQQNLLSKDFLHLFVEDIIFYQRPLCSKKSTIANCTLEKRSYIDKETNERKDAPIKVCAKSNPYYQEFRVLQWLQNLRIYEIETDREVTAEFIETPQDYEALFNFLMSQKEIDNEGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYSGGQANFFDEIHIELGRELKKTAEERKQLSDKNQENENTNLRIKKLLAELKEDASIQNVRPYSLVQQELLKIYEEGVFSSTDEIEEDIQKIRKKVEPTPPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKCISEILSKIVRSDEKDEGVNSKNIIPCTGKITTALKQDWGLNDVWNELILPRFERMNQLTQTQLFTSYNDRLQKNLPTVPIEYSQGFQKKRIDHRHHAMDALVIACATREHINYMNNQHALDKSKDKKEKQQSRIDLHPL

SEQ ID NO: 379 - protein, 303 aa, Capnocytophaga ochracea
MSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKEKRTYATIPLNEVIERQKQGLPSVPERNEKGEPLLFSLSPNDLVYVPMEGEIAETIDFNNLSKEQKERIYKTVSFTGNQCFFVQEAVASPIVNKMEYSPLNKMERDILGIMIKEVCVKLKVDRLGNIIKA

SEQ ID NO: 380 - protein, 1471 aa, Unknown
  Capnocytophaga sp. oral taxon 324 str. F0483
MCKYFYIKNFITFVLSKSIIPMKHILGLDLGSNSIGWAFVQQDFENKQGKIIATGSRIIPMDQGILGDFERGNTVSQTAERTTYRSTRRLRERHLLRRERLHRVLHILGFLPPHYDAQIDFTKRYGKFIDNAEPKIAYNNGNFIFMNSFNEMIEDFKKHQPQLFYKKSNGEESKIPYDWTIYYLRKKALSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDAPIKVCAKSNPYYQEFRVLQWLQNLRIYEIETDREVTAEFIETPQDCEALFNFLMSQKEIDNKGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYGGGQANFFDEIHIELGRELKKTAEERKQLSDKNQENESTNLRIKKLLAELKEDASIQNVRPYSLVQQELLKIYEEGVFSATDEVEEDIQKIRKKAEPSKADLQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNKLILPRFERMNQLTQTQLFTSYNDRLQKNLPTVPIEYSQGFQKKRIDHRHHAMDALVIACATREHINYMNNQHALDKSKDKKEKQQSRIDLRTILCEKKNNNWQFKKPWSTFTQEAKEALEHIVVSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSTEGLEELNKNIAQYNNGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 381 - protein, 1450 aa, Unknown
  Capnocytophaga sp. oral taxon 412 str. F0487
MKHILGLDLGSNSIGWAFVQQDFENKQGKIIATGSRIIPMDQGILGDFERGNTVSQTAERTTYRNTRRLRERHLLRRERLHRVLHILGFLPPHYDSQIDFTKRYGKFIDNAEPKIAYNNGNFIFMNSFNEMIEDFKKYQPQLFYKKSNGEESKIPYDWTIYYLRKKALSQKITQQELAWLILHFNQKRGYYQLRGEEETENPNKEVAFHSLEVVDVEAEAPNKKGEIWYTIRLENGWIYRRTSKIPLDDWKGKTRDFIVTTDLNDDGTIKLDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTPIKVCAKSNPYYQEFRVLQWLQNLRIYEIETDREVTAEFIETAQDNEALFNFLMSQKEIDNESLLKYFLFAKNPQIKDKVAKSELKKWLTTYRWNYVYDAADNSSKKYPMNETGYELQQYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSETCFQGLPLWLAQYVVYNRHAEAADIEKWTSVNDLEAYLEDFKQHSLRNPIVEQVITETLRVVRDIWQRYGGGQANFFDEIHIELGRELKKTAEERKQLSNRNQENENTNLRIKKLLAELKEDASIQNVRPYSPVQQELLKIYEEGVFSATDEVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNELILPRFERMNQLTQTQLFTSYNDRFQKNLPTVPIEYSQGFQKKRIDHRHHAMDALVIACATREHINYMNNQHALDKSKDKKEKQQSRIDLRTILCEKKNNNWQFKKPWSTFTQEAQEALEHIVVSFKQNLRVINKATNYYEKWEEKNGVLVKKKVKQEGTNWAIRKPLHKETVSGKIVLDRKIGKDKILTATRKSVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKIEYSPLNKMERDILGTMIKEVCIKLKVDRLGNITKA

SEQ ID NO: 382 - protein, 1435 aa, Unknown
  Capnocytophaga sp. oral taxon 329 str. F0087
MKNILGLDLGTTSIGFAHIVEDENKEKSEIKELGVRIVSLATDEQSDFEKGKSISTNANRTLKHGARLNLDRYQQRRKFLIDLLQKANLITSASILAENGKNTTHSTWQLRAKAVTERIEKEEFARVLLAINKKRGYKNSRKTKTEDEGQAIDGMAIAKCLYDENLTPGQLSLQLLQQNKKLLPDFYRSDLQKEFDLVWNLQKQFYPDILTDSFYKELQGKGKDATSKAFSKRYHFDTAENKGSKESVRLQAYQWRAEAISKQLSKEEVAYVLTEINNNLNNSSGYLGAISDRSKELYFNRQTVGQYLYAQLQENRHNSLKNKVFYRQDYLDEFERIWETQASFHKELTDELKKQIRDVVIFYQRKLKSQKGLVSFCEFESKEIEIEKDGKAITKSIGARVVPKSSPLFQEFKIWQILNNVTCKRKGIRKKKSSAKSTELDLFNEPSQSIFSLDMECKQLLFDELNLKGDLKSDKVLKLLGYSPQEWEINYNQLEGNRTQKSLYEAYLKIIEIEGYEVKDILQIKSTKDDWSLDESPLSASEIRERVKVIFQTLGICTKILYFDPLLPVKEFEQQYSYQLWHLLYSYESDDSTSGNETLYRILEKKYAFKREHATILANVALQDDYGSLSTKAIRKIYPYIKENQYSTACELAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISEKLQKQFGIKNPTKSDIIRYRLYQELEHNGYKELYTNTYIAPDVLFSKNIDIEHIVPKARVFDDSFSNKTLAFKEFNIKKGESTAFDYITSLNCEGELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKDGNKVTVIKDWTKRNDHRHHAMDALTVAFTKPSYIQYLNHLNARKDENNKNYSVILAIEKKETIKVPINNGKNKRVFIEPILNFRQVAKKHLEEIFISHKAKNKVVTKNINKPAGTDKQQITLTPRGQLHKETIYGKYQYYVNKEEKVGVKFDERTITKVSNPLYREALLKRLQANDNDPKKAFAGKNALSKNPIYLDEAKTKTLPEKVNLTYLEEDFSIRKDISPDNFKDLKSIEKVIDQGVKRILIKRLQAYDNDPKKAFVDLEKNPIWLNKEKGIAIKRVTISGVSNAQPLHIGKDHLGKTTLNKEGKEVPVDYVSTGNNHHVAIYRDKEGNLQEQIVSFFEAVVRAQQGLPIIDKNYKQAEGWQFMFTMKQNEMFVFPNEATGFNPAEIDLLDPKNKKLISPNLFRVQTISIVKYGNSVVRDFKFRHHLETTLQDDKILQGITFQQIKSLEPLRNIVKVRINHLGDIVNIGEY

SEQ ID NO: 383 - protein, 1432 aa, Unknown
  Capnocytophaga sp. oral taxon 380 str. F0488
MKNILGLDLGTTSIGFAHIVEDENKEKSEIKELGVRIVSLTTDEQSDFEKGKSITTNANRTLKHGARLNLDRYQQRRKYLIDLLHKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTAENKGSKESVRLQAYQWRAEAVSKQLSKEEVAYVLTEINNNLNNASGYLGAISDRSKELYFNRQTVGQYLYAQLQENRHNSLKNKVFYRQDYLDEFERIWETQALFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSTKDDWSLDESPLSASEIRESVKAIFQALGICTKILYFDPLLPVKDFEEQDSYQLWHLLYSYESDDSTSGNETLYRILEKKYAFKREHARILANVALQDDYGSLSTKAIRKIYPNIKENQYSTACEMAGYKHSKLSLTTEELEARELKNIIPLLKKNALRNPVVEKILNQMINVVNALIEKNSERDAEGKITKYFHFDEIRIELARELKKNAQKRYEMTQNINKAKSEHQKISEILQKEFGIKNPTKSDIIRYRLYKELEHNGYKELYTNTYIAPDVLFSKNIDIEHIVPKARVFDDSFSNKTLAFKDFNIKKGESTAFDYITSLKNEEKLNQYLARVENAYKTKNISPAKYKNLLKKASEIGDGFINRDLRDTQYIAKKAKEILFQVTKNVLSTSGSITDRLREDWSLVDVMKELNMPKYQSLGLTEVEERKDGNKVTVIKDWTKRNDHRHHAMDALTVAFTKPSYIQYLNHLNARKDENNKNYSVILAIEKKETIKVPTNNGKNKRVFIEPIPNFRQVAKKHLEEIFISHKAKNKVVTKNTNKPAGTNKQQITLTPRGQLHKETIYGKYQYYVNKEEKVGVKFDKETIAKVSNPLYREALLKRLQANDNDPKKAFTGKNALSKNPIYLDEAKTKTLPEKVNLTYLEEDFSVRKKIVPKNPTSKEFVPNLKSIEKVVDEGVRNILIERLRVYNNDPEKAFVDLEKNPIWLNKEKGIAIKRVTISGVNNAQPLHIGKDHLGKTTLNKEGKEIPVDYVSTGNNHHVAIYRDKEGNLQEQIVSFFEAVVRTQQGLPIIDKTYKQEEGWQFLFTMKQNEMFVFPNEATGFNPAEIDLLDPKNKKQISPNLFRVQKIATKDYFFRHHLETNVETDNVLKNTTWKREGLSGLKDIVKVRINHLGDIVSIGEY

SEQ ID NO: 384 - protein, 1426 aa, Unknown
  Capnocytophaga sp. oral taxon 335 str. F0486
MKNILGLDLGTTSIGFTHIVEDENKEKSEIKELGVRIVSLTTDEQSDFEKGKSISTNANRTLKHGARLNLDRYQQRRKFLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQKEFDLVWNFQKQFYPDILTDSFYKELQGKGKDATSKAFSKRYHFDTAENKGSRESVRLQAYQWRAEAISKQLSKEEVAYVLTEINNNLNNASGYLGAISDRSKELYFNRQTVGQYLYAQLQENKHNSLKNKVFYRQDYLDEFERIWETQASFHKELTEELKKQIRDVVIFYQRKLKSQKGLISFCEFESKEIEIEKDGKTITKSIGARVVPKSSPLFQEFKIWQILNNVTCKRKGIRKKKSSAKSTELDLFNEPSQTIFSLDMECKQLLFEELNLKGDLKSDKVLKLLGYSPQEWEINYNQLEGNRTQKALYEAYLKIVEMEAHDVKDILQIKSTKDDWALEESPLSASEIRERVKAIFQTLGICTKILYFDPLLPVKEFEEQDSYQLWHLLYSYESDDSTSGNETLYRILEKKYAFKREHATILANVTLQDDYGSLSTKAIRKIYPYIKENQYSTACEKAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISGILQKEFGIKNPTKSDITRYRLYQELAHNGYNDLYTNTYIPKELLFSKNIDIEHIVSKARVFDDSFSNKTLAFREFNIKKGESTAFDYITSLNNEEELNQYLNRVENAYKTKNISPAKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDKNNKNYSVILAIEEKETIKVPTNNGKNKRVFIEPIPNFRQVAKKHLEEIFISHKAKNKVVTKNTNKPAGTDKQQITLTPRGQLHKETVYGKYQYYVNKEEKIGVKFDKETIAKVSNPVYREALLKRLQANDNDPKKAFAGKNALSKNPIYLDEAKTKTLTEKVNLTYLEEDFSIRKDISPDNFKDLKSIEKVIDQGVKRILIKRLQDYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFEAVVGAQQGLPIVDKTYKQAEGWQFLFTMKQNEMFVFPNEATGFNPAEIDLLDPKNKKQISPNLFRVQKIATKDYFFRHHLETNVDTDNVLKNTTWKREGLSGLKDIVKVRINHLGDIVSIGEY

SEQ ID NO: 385 - protein, 1450 aa, Unknown
  Capnocytophaga sp. oral taxon 326 str. F0382
MKRILGLDLGSNSIGWAFVEQDFENKQGKIIATGSRIIPMDQGILGDFEKGNTVSQTAERTTYRSMRRLRERHLLRRERLHRVLHILGFLPPHYDAQIDFTKRYGKFIDNAEPKIAYNNGNFIFMNSFNEMIEDFKKYQPQLFYKKSNGEESKIPYDWTIYYLRKKVLSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTFIKVCAKSNPYYQEFRVLQWLQNLRIYEIETDREVTAEFIETAEDYEALFNFLMSQKEIDNEGLLKYFLFAKNPQIKDKVAKSELKKWLTTYRWNYVYDAADNSSKKYPMNETGYDLQRYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSESCFQGLPLWLAQYVVYNRHAEATDIEKWTSVSDLETYLEDFKQHSLRNPIVEQVVTETLRVVRDIWQQYGGGQANFFDEIHIELGRELKKTAEERKQLSNRNQENENTNLRIKKLLAELKEDASIQNVRPYSPVQQELLKIYEEGVFSSTDQVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITGNKEVTIFTEEQYKEFVKKHYANNSAKQQKLLLNEIPEKMVARQLNDTRYISKYISEILSKIVRSDEKDEGVNSKNVIPCTGKITTALKQDWGLNDVWNELILPRFERMNQLTQTQLFTSYNDRFQKNLPTVPIEYSQGFQKKRIDHRHHAMDALVIACATREHINYMNNQHALDKNKDKKEKQQSRIDLRTILCEKKNNNWQFKKPWSTFTQETKEALEHIVVSFKQNLRVINKATNYYEKWEEKNGVLVKKKVKQEGTNWAIRKPLHKETVSGKIVLDRKIGKDKILTATRKEVDITFTEKIISSITDTGIQKILLNYLNYKGSPEVAFSAEGLEELNKNIAQYNDGKKHQPIYKVRIFEEGSKFPLGETGAKATKFVEAAKGTNLFFGVYQGKEKRSYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 386 - protein, 1437 aa, Unknown
  Capnocytophaga sp. CM59
MKYIKYILGLDIGSNSIGWALIQLDLLQKTKRIIATGSRIIPMDQKVLSDFGKGITISPTAQRTSYRNARHCRERHLLRRERLHRVLHILGFLPTHYDKQIDFSKRYGKFVDNTEPKIAYNERKFLFMDSFQEMLADFKIHQPDLFYTKKNGEESKIPYDWTIYYLRKKALSRKISKEELAWIILNFNQKRGYYQLREEEEENKENDFEIISSKIISVIKKDKDKKYNKYWYDIILENGLVYQAAFYNDFVYNWINQDREFIIERISLKNGTEKVKLSYLPTFDEIDKMDKKEQDKYYKKIKIKTENSIGNKTVGCYIYDHILQNPNEKIKGKLVRTIERKYYKEELKAILEKQVALQPELFTDQLFADCIRELYSKNEAQQRNLAARDFVHLFVEDIIFYQRSLRRQKSTLANCSLESRSYIDKDSHTRKEAPLKVCPKSNPYYQEFRVLQWLQNLKIYEIDTDQEVTHEFIKTLEDKQQFFDFLMNQKEIDCEELLKYFLNQTYPNAREKALKSELKKWKDTYRWNYVYDIGEKSSKKYPMNETRYELKRHLEKVANLPDDFLSSEVEYLLWHLIYSVKDKVAYEKGLKTFAQKHHLDKDSFVESFKKFKPYPSEYGSFSEKAIRKLLPLMRFGSYWDFNHIDKNTQKRIEDLITGVENEEIRTILREKAEKYQLEKETDFQDLPLWLAQYIVYNRHAEASSLEKWTSVNDLETYLNEFKQYSLRNPIVEQVVMETLRVVRDIWQQYGQGQASFFDEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSTENKTIKIFTEEQYRTFIKEHYSNNPEKTKKLLLEEIPEKMVARQMNDTCYISKFISEILSKIVRSDEQDEGVHSKNVILCTGKITSALKQDWGVNDVWNDLILPRFERMNDLTQSTLFTTYNEKYQKYLPTVPMEYSNGFQKKRIDHRHHAMDAIIIACATREHINYINNQHALEKGKDKKEKQKEHDKLREKLCIKKDNKGSEENYSWIFKKPWDTFTQEVQAALEGIVVSFKQNLRVINKATNYYERWVEENGKYIKKMVKQEGTNWAIRKPLHEETISGKIYLDREEITKNDILTATRKTVDSSFDEKRIKKITDTGIQKILLNYLKYKGSPEIAFSPEGLEELNKNLSIYNDGKPHKPIYKVRIYEKGSGRFALGEKGRKYKKYVQGAPNLYFGIYQGANKRSFATIPLNEVIERQKQGRPSIPEYNEKGDPLLFSLSPNDLVYVPVEGEIIEDIDFQNLSKEQKERIYNVNDFSSTCYFTPNRIAKAIFPKEVDLQRKGDKLPGSYDTKTASLEGIQIKEVCIKLKIDRLGNISKA

SEQ ID NO: 387 - protein, 1140 aa, Catellicoccus marimammalium
MKNMTKVNVGLDVGISSAGWSVINAETNQILESGVRLFSGSDADENVNRRNQRQGRRLFRRRKLRIQEAKKYLENVFQLKDIEPKDEWNPYEIRVRALNEKVSKEELSIALLNIVKHRGISYELEDVTDEEGTNTQSFQSGLDYNRRLLKTKTVGEIQYDRLQKYGQVRGQIQTEDGLLINIFPTKNYVEEVERILETQKKYHPEIDDVFIEKIISFVTRKREYFVGPGNEKSRTDYGIYRENGETLDNLFEILIGKDKFYPEEYRAAGSSYTAQIFNLLNDLNNLRIPTTEDHHLTKAQKEEIITELKNTSRLSGGMLKLISKVTKAPKEEISGYRKDEKDKPDLHSLAYYRKQKNMLEKEGIQIADFSEELLDELATMMTLNTEPGEIRKQLNKITNQYDILTPEVIEVLVKNHTAFVATSNHKWHRFSLKLMKEFIPELLETSKEQSTILCERGFIQNRASYLDENHHFNYAELRENLYNPVVRKSTCEMLKVFTAIQEKYPNIQNVIVELPRETNEDEQKRKIKKINDNNAKRKKEILKEAQAQSGLSEEALEEKLLKTKGLYLKLMLWYEQEGKCVYSGQEIPLSDLLQNKGGYEVDHIIPISISFDDRLCNKVLVRQQLNSQKSNQTPFEYMTTHTDGHLSFHELKELVGKNKRFSKEKRELLLAEIYSNDIETRKRFINRNLVDTSYTARIVLNALQQYKKENQLSMNVSVVRGAMTNILRKKVKLDKTRETFHHHAIDASLMAVIPNIEFFKERKEWLPKSANEEVVEVEVSEEETMPEKEFKVKMRLPESFIQDVQILQRNSFAKEEVSGPQTRERNLKIKFSHQVDQKMNRKVADDTIYGTRQAQLGKDKKEETYVIGKIKDIYNYDEYVRFKKRYDKNKESFLMYHHDPQTFEKLEEILAQYPEYIEDEKGKKKKVSPFALYREENGPVTKYAKKNNGPVIKQLKYYDSKLNRKIDISHKYSTKNRQVVLQSLKPYRTDVYRNQDTGEYTLVGIDQNDGKFVNGHYGIPKSRYEEIKANNKLSEHDEFVFSLYKNSMVKVIDENGESIVVRYLSRSMPNRKNNAEIKPVEKYQFEDGEVVPVYGKCRKQMQTVFVKKGWTLLKGNTDILGNTYFVEKESENPKKMIDDK

SEQ ID NO: 388 - protein, 1419 aa, Unknown
  Chryseobacterium sp. CF314
MMIKNILGLDLGTNSIGWALIKQNFENKYGEILGMGSRIIPMSQDVLGEFGKGNSVSQTAARTGYRGVRRLRERFLLRRERLHRVLNVLNFLPEHYASQIDFEKRFGKFKYETEPKLAYNNDGFFFKNSFDEMLGDFKDHQFHLLENGRKVPYDWTIYYLRKKALSQKIEKEELAWILLNFNQKRGYYQLRGEDFEEEKDRVFVRLKVDRVVDSGENIKGKILYDVYFENGWKYEKQIVKTEDWIGRTKEFIVTESILKNGDTKRTFKAVDSEKDWIAIKTKTEQEIDKSHKTVGAYIYEALLQNPKQKIKGKLVRTIERKFYREELKKILERQKEFHPELQSDDLYNDCIRELYRNNEAHQITLSKKDFVHLLLNDLIFYQRPLRSQKSSVSNCTLEFRKYKDENGVEHAQYLKTIPKSNPYYQEFRVWQWMFNLNIYRKDDDTNVTKEFLSSTEDYETLFEFLNNRKEVDQKALLRHFKLNEKTHRWNYVEDKKYPCNETKTMISTRLEKVENYPSDFLTREMEQNIWHIIYSVNDKIEYEKALKSFAHKNNLDENSFFEAFKKFPPFKSEYGSFSEKAIKKLLPLLRLGKYWNWESIDRKSQGRIEKIITGEFDGNIKDKVREKAIHLTAENDFQGLQLWLAQYIVYGRHSEASMIGKWNSADDLEEFLKGFKQHSLRNPIVEQVITETLRVVKDIWLKYGNGAKDFFSEIHIELGREMKQTKDERVDATKRITENENTNLRIKALLAEMMNDNSVENIRPYSPMQQEILKIYEDGILKSDIEIDDDILKISKTAQPSSSDLKRYKLWLEQRYKSPYTGQIIPLNKLFTSEYEIEHIIPQSRYFDDSFSNKIICESAVNKLKDNYIGLGFIKQFGGMIVECGFGKSVEIFKAEEYEDFVKKHYANNRSKRNKLLLEEIPEKMIDRQLNDTRHISKYISGVLSNIVRQEDGTDEGVNSKNIVPGNGKITTQLKQDWGLNDVWNELILPRFERMNQLTNSTDFTSWNKNHQKFLPTVPIEFSKGFSKKRIDHRHHAMDALVIACATKDHINLLNNQSAKSDTKRYDLKRKLMKFERVVYSHSKTGEKIEKEVPKQFLKPWDNFTVDAKNKMETIIVSFKQNLRVINKATNHYEKWIEKDGIKRKELIKQEGTNWAIRKPMHKETVSGKVDLPGIKIPKGKILTATRKSLDTSFDLKTINSITDTGIQKILKNYLEFKGSSELAFSPEGIEDMNKNIEKFNDGKPHQSINKVRIFELGSKFSVGQTGNKKDKYVEAAKGTNLFFAVYEDKNGKRSYETIPLNEVIERQKQGLDSVSFKNKEDFLLCPNDLVYVPSEDELENIYNIDFKNLTTEKTGNIYKVVSFSGNQIFFIRQDIAISIVNKAEFSTLNKMERAIDGSMIKENCIKLKIDRLGNIAKI

SEQ ID NO: 389 - protein, 1065 aa, Clostridium perfringens
MNKDINYALGLDIGITSVGWAVINLDLNRIEDLGVRIFNAAENPKDGSSLALPRRLARGRRRLLRRKAYRVERVRKLIVKNNILTKEELEGLFKNKEVIDVWEARVKGLDYKLSREEWAKILINFCKRRGFKSNRKNETKDKEAGQILSSISYNIEKMKETNSRTIGEYIYNEVKNSDDSYAPLRNKFGEYKMCVSRDVLREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEDELFSTLTYSIDKDISKTENTKFVSLKGYHEIKRAIEKGVSKKAWQDIENNRNLLNDIAYVLTLGKTDDEIEKQLRLRNVPEELFESLLDMSFSKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTAVEVLKYRLWEQQRGECAYTQSQIALERLFSPGYCEIDHIIPFSRSFDDSLSNKILVLGSENQRKGNKIPYEYFGEDSERWNSFEIWVKGSYLNYKKKANLLKKKFTEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKLPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAAPFKDGIPMNEGLVAKEGMVRIDIYEKEGKYFVVPVYRYQLAKGIVPKRAAIAGKSELKWPIMDQTYNFKFSIFKNDLIEIKYAKKDGYFGYYDGFDRHTASLVIENHDNSDRYRGIGVKTGVVEFNKYEVDVLGNYHKVNLGGN

SEQ ID NO: 390 - protein, 1099 aa, Corynebacterium accolens
MSLSYRVGIDVGTYSLGCTAIEVDDNDQPVNILSSVSLIHDSGLDPDQQKRAVTRLASSGVARRTRRLYRRRRRRMINLEKFLTSQGWETRPFEHYSDPYLPWNARVALVNGYISDDAQRGMYLSIAFRHIANHRGWRNPYWKVSSLYSPDKPSDAFEQIRKELEESTGHKIPETVTVGQLISFAQFGKDRLRGGGKKKDEKKPQEQVNQAVISARLHQIDHAREINEICRVQKIDDALRKQILDLVFAAESPKGAQIGRVGKDPLQPKLPRALKASDAFQQYRIVALAGNLRIYRDGVSTPLDRDEKLIVFNYLINLSHKEEPSWLKVAEVLNIDRGQLHGTATMTDDGERAGAAPPVHDTNRTILGCKIKPLVHWWEGANDDERAAMLKALSNSEVEDFDSPAGAQTQAFFANLDESEQEKLDSLHLPIGRAAYSEDTLMRLTSRMLDENLDLYEARLAEFDIPKDWAPPAPRIGEPVGNPAVDRVLKGVARWLEAAADEWGAPKSVVIEHVRDGFISKSKANEIDRANNARHKRNRELFKQMQENLGIDGKLRSSDLWRYQSVQRQNCQCAYCGSPITYTTCEMDHIVPRAGEGSTNTRDNLVATCHRCNLAKKNIPFAVWAAQTNIPGVSVKEALDRTRHWSEDSGMTSKDFKKFRKNVCDRLKRTVVDEPLDARSMESVAWMANELRGRVAQRFQEENTVVNVYRGELTAEARRAAGISDKLRFIDGTGKSRLDRRHHAVDAAVVAFTQNYVAETLAIRSNKKREAQLLQAAEQWKEFTGSDAEHRAAWNAWLPKMQKLAVLLQKALDEDRIAVTSNLRLRLGNGRAHEDSIGELKTIRVGDAISVTDIDRASSEALWCALTREPDFDENNGLPENPDRRIRIHGTWYDAEDDIEVFPVGAGAIKVRGGYAELSRFHHARIYKIPGKKAPVYCMLRVYNADLIRHRHEDLFSVEIKPQTMSVRQAEPKLRKALAENTAEYLGWLVTDDELVIDTSNFNTGQIAEMQSELGQVRRWRLDGFYSPSTLRLRPLQMSAEGLREDTSIGAKKIIDRPGWLPAINKLFGEGHVTVVRRDALGRARLTSNAHLPISWKAE

SEQ ID NO: 391 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVWVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPERAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRATWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 392 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMQRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSPDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLGSQLSVSDIDKASSEALWCALTREPDFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 393 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLKSATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 394 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 395 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDSFQRYRIAALISNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVRDGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKELAPELSKIIDRPGWLPAVNKLFSEGNVTVVRRDSLGRVRLESTAHLPVTWKVQ

SEQ ID NO: 396 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 397 - protein, 1084 aa, Corynebacterium diphtheriae
MKYHVGIDVGTFSVGLAAIEVDDAGMPIKTLSLVSHIHDSRLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNIQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRVTMDEEIDARSMESVAWMANELRSRVAQHFASRGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 398 - protein, 1069 aa, Corynebacterium matruchotii
MAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQVGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 399 - protein, 210 aa, Diplosphaera colitermitum
MSDILDKPIVLSLNRAWQVIGHRTVKQALVALNGGNADLPPALGLDIAYPKFDDGAWNFDRPLFLNPLPWSEWIELPVRDFDFAITTPRLRIRVPTVIVATQFAKMPVRIPRLTREAIFERDGGVCQYTGEHVGKHGGNLDHVVPRDRGGRDSFENLVWAKREINSLKANRLPHEAGLRLLRRPKAPAPLPASMTIREARHPDWRHFLTP

SEQ ID NO: 400 - protein, 1332 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 401 - protein, 921 aa, Enterococcus faecalis
MIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNRILFLEEKGFLRPRVLMKLPKYTLYEFPEGRRRLLASAKEAQKGNQMVLPEHLLTLLYHAKQCLLPNQSESLTYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 402 - protein, 1337 aa, Enterococcus faecalis; identical to SEQ ID NO: 110

SEQ ID NO: 403 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 404 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSTPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 405 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 406 - protein, 936 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETR

SEQ ID NO: 407 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 408 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENLGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 409 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 410 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGVNDVVKLLGVKKERLSGWRLDKKGKPEIHTLKGYRNWRKIFAESGIDLAMLPTETIDCLAKILTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 411 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDRLIGKDFQGELRASGLSLSAQQYNLLNDLTNLKIDGEIPLSPEQKEYILAELMTKEFTRFGVNDVAKLLGVKKERLSGWRLDKKGKPEIHTLKGYRNWRKIFAESGIDLATLPTETIDCLAKVLTLNTEHEGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANHETKVRVVNGSFTHTLRKKWGADLDKTRETHHHHAVDATLCAVTPFVKVSRYHYAVKEETGEKVMREIDFETGEIVDEMSYQEFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 412 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINVQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTPFVKVSRYHYAVKEETGEKVMREIDFETGEIVNEMSYREFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEIMPAENQFKQKPYNNGAINLNIAKYGKEGKKLRKFNTDILGKKHYLFYEKEPKNIIK

SEQ ID NO: 413 - protein, 1150 aa, Enterococcus faecalis; identical to SEQ ID NO: 178

SEQ ID NO: 414 - protein, 1150 aa, Enterococcus faecalis; identical to SEQ ID NO: 179

SEQ ID NO: 415 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 416 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 417 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 418 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 419 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 420 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 421 - protein, 892 aa, Enterococcus faecium
MTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMEQWLEDPELASMFEEIIKTLTVFEDREMIKTRLSHHKATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 422 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 423 - protein, 116 aa, Unknown
  Enterococcus sp. 7L76
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTELLSKGEIYKVTLHILKNVELVT

SEQ ID NO: 424 - protein, 1391 aa, Unknown
  Eubacterium sp. AS15
MENKQYYIGLDVGTNSVGWAVTDTSYNLLRAKGKDMWGARLFDEAKTAVERRTKRTSRRRSEREKARKAMLKELFADEINKVDPNFFIRLEESKFFLDDRSENNRQRYTLFNDAKFTDKDYYEKYKTIFHLRSALINSDEKFDVRLVFLAILNLFSHRGHFLNASLKGDGEIQGVDIFYNDLYEVCEEFEIDLPQISNIDNFEKILSQKGKSRTKILEELSEELSISKKEKIKYSLLKLICGMKIKVVDIYADEDIQEDDKKKDLGFRESDYEKSSLEVKEIIGDDHFELIERAKAVHDIGLLANIIGNSKYLCEARVEAYDNHHKDLQKIKELLKKYDIKAYTDMFRKMTDKNYSAYVGSVNSNIAKERRSVDNRKIEDLYEYIKKIALKNISDDNEDKIEILKKIETGEFLKKQLTASNGVIPNQLQSRELRAILKKAENYLPFLKEKGEKNLTVSEMIIQLFEFQIPYYVGPLDKNPKKDKNANSWAVIPSGGRILPWNFEDKVDVKGSRKEFIEKMVRKCTYLSEEHTLPKQSLLYEKFMVLNEINNIKIDGEKISVEAKQKIYNDLFMKGKKVSQKAIKQELISLNIMSKDSVLSGIDTVCNAYLSSIAKFRGVFDENVNNQSTIDMIEDIIFLKTVYSDEKRFVKEEIVEKYGDEIDKDKIKRILGFKFSNWGNISKSFLELEGADVGTGEIRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYSAIKEDSKQWVKELDAKDESYFRSKKMYLYYLQKGRCMYSGEVIELDKLMDDNLYDIDHIYPRSFVKDDSLDNLVLVKKEINNRKQNDPITPQIQASCQGFWKVLHEQGFISNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPAYKYHMDRFFERDVKSKSEVAWIGQSEGNAGTIAIVKKTMSKNSPLITKKVEEGHGSITKETIVGVKEIKFGRNKVEKADKTPKKANLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 425 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 426 - protein, 1142 aa, Facklamia hominis
MYSVGLDIGIASCGYSIINDVNGNIVELGTLLFKSRNSDNNEERRTNRGSRRLINRRRTRLDDGKKLLAEKGFKQDSKLKHVCPYELRVKGLHEKLTQGEIYKVVLHILKKRGISYLDESDENSSGIDGASYKDQVNLNLNLQKELTPGQIQLKRLKENGRIKSGVTFENGYQLNVFSVSAYANELNKILTKQSEYYSEIDQIWIDRFTKNGYRKEAGLVYRKRPYYDGPGNEKNNSIYGRWANFKEDGHPKENIFDQLIGLDSVDSTQVRASASTLTAQKYNLLNDLNNLTIIEDDRKFTTDEKVSIINYLMTQDITRFGPKELAKFYQLEVDQIRGWRIDNKGNPEIHSLKVYRDWKKIFNTSSIDLTSIQTWVVDELANVITLNTEIPSTLATLKIKIPDIDQQILNFVENNFYELKKKTSKNSWHSFSLKTLNILIPELLNTSEEQNTILERLNLKFDLKNKYAEKNQIPVKELLEQIYNPTVTKSVHQSIKLFNEIIEKYGKNNISYVTIEMPRDKNDQDQKDTIKRINKLNSERKNDSEKYFLERSGWDTIRFESALKKPRFAEKLLFYYEQKGKCAYSGQDILAESLLNESCEVDHIIPLSISFDDSIHNKVLVTASSNQEKGQRTPYMAFIDGAKLGQSWDDFVAWVNSCGFHRKKVQNLLYEENIFNPDVQRGFVSRNLNDTRYASRIVLNAIQSFFYKQKDLTKVKVVNGSFTHTLRKKWGSSLDKNRDTYHHHAVDATLCAVTPFINIVKYEFFEEDGIKYMVDLTTGEKVAYSDYKKMKFYDKRAYVPIWDGFIKQLTPANLYPKIKFSHQVDSKWNRKISDATIYSTRKIVETKINKKGVAKETVKDIVIDKIKDIYTPEGWRKFKEKQDKLLMKNFDEKTYNKLIKIAKEYPEKKEVQTSNGKVSLVEVSPFKMYCEEQNVPAIRKYSKKGNGPYIRSLKFYDKELGKHINITKDSYGNDIERTIRNKKIILKNQNSWRTDVYYNSVNNCYELLGIKYCHLKFYRGKYGIPKSIYDELKKEDEISSESVFKFSLYRHDRVRFEKDGEYIEALFGSKNESNKNYLELSPIDKNKWLSKENVKFFGEVAASGRFIKGLKPGIKVIKQSTDYMGHVYAIHQEKLKFVLSDA

SEQ ID NO: 427 - protein, 1347 aa, Finegoldia magna
MKSEKKYYIGLDVGTNSVGWAVTDEFYNILRAKGKDLWGVRLFEKAKTAADTRTFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEAVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRIKGKPLDTDVKLKLIEELFKKKTKVTLKSIRDYMIRNNFADKEDFDNSEKNLEIVSNMKSYIDFNNILGDKFELEMVEDLIEKITIHTGNKTLLKKYIEETYPDLSSSQIQKIINLKYKDWGRLSRKLLDGIKGRNKTDDVNTVINFMRNSSDNLMQIIEGKNYSFNEYIDNLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDESELRSKKLYLYYTQMGRDMYTGEKIDLDKLFDSTHYDKDHIIPQSMKKDDSIINNLVLVNKNANQTTKGNIYPVPSSIRNNPDIYNYWKYLMEKEFISKEKYNRLIRNTPLTNEELGVFINRQLVETRQSTKAIKELFEKFYQKSKIIPVKASLASDLRKDMNTLKSREVNDLHHAHDAFLNIVAGDVWNREFTSNPINYVNENREGDKVKYSLSKYFTRPRKSKGKVIWTPEKGRKLIVDTLNKPSVLISNESHVKKGELFNATISGKKDYKKGKIYLPLKKDDRLKDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 428 - protein, 1348 aa, Finegoldia magna; identical to SEQ ID NO: 222

SEQ ID NO: 429 - protein, 1516 aa, Flavobacteriaceae bacterium
MLKQQKDKIIGMNKKILGLDLGTNSIGWALVKQDLENKYGEIIGCGSRIIPMSQDVLGKFDAGISISQTAERTNYRSVRKLIQRNTLRRERLHRVLHQLDFLPKHYNDSIDFEKKLGQFKTDKETKLNYFVNQHGKHEFLFKDSFNEMVKEFKEEQPELFYIKNNGKETKIPYDWTIYYLRKKALSKKISKEELSWLVLNFNQKRGYYQLRGEIDEEKEKNKRYEKLYVSEVVKTNNTIKKTGEYLYDIYFDNGWKYEKQTTKPQDWLHKHKEFIITTTTLKNGETKRTFKTVDSEKDWIAIKSKTEQDIKESNKTVGAFIYDTLLKNPTQKIRGSLVKTIERKFYREEFEKILKEQIKHRPEINVNTAIGKENYTKCVTELYPRNEAHANNILTNDFNYLFTKDILFYQRPLKSKKSEIANCQYEYRTYIKKKEKTGKEERVKQPLKATPKSHPLFQEFRLWQFIHNLKIYIRETTVGNKPLFDVDITDTFFTSENDWATLFEYLNNKKEIEQKHVLEYLVSKKIISKSEKTDYRWNYVEDKKYPGNETRVDFINRLKKVENLNVDEFLTSELEFKLWHIIYSVTDKNEYEKALENFAIRQNIDKDSFVNSFKKFPPFKSDYGAYSTKAIKKLLPLMRLGKFWDGSEIPKVVVEKITDIKTRLTSVNYDESLFKKDEKKILETIVDDITPKQLLKSFVKLKGKNHLAGLNTYQACYLVYERHSESSDITQWENPDDIDSFLNHFKQHSLRNPIVEQVVTETLRTVRDIWKYYGNGSPNYFNEIHIELGREMKNPADKRKQMSAKINENENTNQRIKGILQELMNDGVQDIKPYSPSQQEILKIYEEGISQNPNVDYSKVSEDEITKIKKSNNPTLKEIQRYKLWLEQKYISPYTGKPIPLSELFTPAYQIEHIIPQSRYFDNSLSNKIICESEVNEDKSNKTAYEYLKTNGGSIVHGHHLLSLKEYEDHCQHYFKKNRTKLKNLLSEEIPEGFINRQLNDSRYISKLIKGLLSNIVREENEQEATSKNIVPVTGSITSKLKQDWGLNDKWNEIIAPRFKRLNKMTNSNDFGYFDEKINTFRIQVPDAISRGFNKKRIDHRHHTLDALVIACCTKKHIQYLNSLNNEIIKHELKPSILIKNAQGDYTKHFMLPWNNFPIDCKNAIENTIVSFKQNLRVINKTSNKYQSYKDENGNLRLGKDGKPKKGLTKQTKGNNWAVRKAMHEDTFYGEIVDGENKGKLKIKTLLDTSFDVKKIEDKVLDKSIRTILINYLKQDKYKNLSKPHEEAFSPNGIIEMNKNIISLNNNIPHKPIKRVTLKHEKGKKFSIKTLLDKKTKFAKSATGTNVFFCIYKNINGKIKYHTPSFEEIIEIQKQEFEIKYKSKLNVPETLFDKKESFELLFYLQPNDLVYLPNDEELKNRQLIDFNNLNKKQIKRIYKFTDGSGTTANFIPYQVAKVIFNLNKKEQAKSSFKYPIQNEFGVGSPQSKNQKSIEGILIKERCIKLKIDRLGNISKA

SEQ ID NO: 430 - protein, 1629 aa, Unknown
  Francisella cf. novicida Fx1
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINIQILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYRSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAITTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLANNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNITIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 431 - protein, 1646 aa, Unknown
  Francisella cf. novicida 3523
MNIKILPIAIDLGAKNTGVFSAFYQKGTSLESLDNKNGKVYELSKDSYTLLMNNRTARRHQRRGIDRKQLVKRLFKLIWTKQLNLEWNKDTQQTISFLLNRRGFSFITDGYSPEYLNIAPEAVKAILMSILDDYNGEDDLDSYLQSATENDSKIDELYNKLLQKALEFKLRKLCIDIKEDKVTTKTLKELSNTEFKLLANYLVDYDRILRTQKFSYTDKQGNLRELNYYHHDKYNIQEFLKRNIIINDVILEKLTDDLDIWNLNFDKFDFEKNLEKLENQEDKDYLQTHLHHFVFAVNKIKSEMASGGRHRSQYFQEITNVLVENNHQEGYLKNFCENLHNKKYSNLSVKNLVNLIGNLSNLELKPLRKYFNDKIHAKADYWDEQKFAETYSDWILGEWRVGAKDKDKKDGAKYSYKNLCDELKQKVGINQDGIINQTKSDFVDFLLELDPCRTIPPYLDNNNRKPPKCQSLILNPKFLDNKYPNWQQYLQELKKLQTVQNYLGNFEIDLKDLKSSKEQPYFVKYKSLNQQIASGQRDYKDLDARVLQFIFDRVKASDELLLNEIYSHAKKLKQNTSSELEKLELCKKLDEVIANSQLSQILKSQHVNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNQASKLEFDRKIKKFNSIYSFAQIQQIAFAERKGNANTCAVCSADNAHRMQQIKVAKPVEGNKDNIILSAKAQRLPAIPTRIVDGAVKKIATILARNIVDDNWDNIKQALSNNQQLHVPIITESNAFEFEPALADIKGKSLKDKRKKALERIDPENVFKDKNNRIKEFAKGISAYSDANLANGDFDGAKEELDHIIPRSHKKYGTLNDEANLICVTREDNQNRGNKAVFLYDLKPNYKLKQFNTTDDLEIEKKIADTIWDASKQDFKFGNYRSFINLTPQEQIAFRHALFLADKNPIKKAVIRAIDNRNRTFVNGTQRYFAEVLANNIYLRAKKENLATNRITFDYFGIETTNSNGRGIADVRKLYEKVDSDIQAYAKGDKPQDSYSHLIDAMIAFCVAADEHKNEGSIGLKMGNQYGLFPTPDKYDENTGEIISWHNDDIFRKIKVSDNQFSDKKLVRKKATEGFNTHRQMTRDGIYGESYLPILIHKNLNEVRKGYNWENSEEIKIFKGKKYDIQQLNNLVYCLKFVDKPISIDIQITTLEELRNILETNNISTTAEYYYINLKTQKLHEYYIENYNTALGYKKYTKEMEFLRSLAYRTERVKIKSIDDVSMILAKDSNFKAGKIELPFKTEWQRLYLEWQNTTIKDNHEFLKSYFSVKNATKQHKKVRKDFSLPISTNEGKLLVKRKTWDNNFIYQILNDSDSRADGTKPFIPAFDISKNEIVETIIKSFTSKNIFWLPKNIELQKVDNKSIFAIDTSRWFEVETPKDLIEIGVSTIQYKIDNNSRPKVRVKLDYVMDDDSKINYFMNHSLLKSRYPDKVLEILKQSTIIEFESSGFNKTIKEMLGMTLAGIYNETSNN

SEQ ID NO: 432 - protein, 1629 aa, Francisella novicida
MNFKILPIAIDLGVKNTGVFSAFYQKGTSLERLDNKNGKVYELSKDSYTLLMNNRTARRHQRRGIDRKQLVKKLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGLKDQDKKEGAKYSYKDLCNELKQKVTNAGLIDFLLELDPCRTIPPYLDNNNRKPPKCQSLILNPKFLDNQYPNWQQYLQELKKLQIIQDYLESFETDLKVLKSSKDQPYFVEYKSSNQQIASGQRDYKDLDARILQFIFDRVKASDELLLNEIYFQAKKLKQKASSELEKLESSKKLDEVIANSQLSKILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQVYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 433 - protein, 1629 aa, Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTTIEFESSGFNKTIKEMLGMTLAGIYNETSNN

SEQ ID NO: 434 - protein, 244 aa, Francisella tularensis
ARKQNSEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQNQEDKDHTQAYLHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 435 - protein, 501 aa, Francisella tularensis
MEIEKKIADTIWDASKQDFKFGNYRSFINLTPQEQKAFRYALFLADENSIKQAVIRAINNRNRTFVNGTQRYFAEVLANNIYLRAKKENLNTDKISFDYFGIPTIGNGRGIADIRQLYEKVDSDIQAYAKGDKPQASYSHLIDAMIAFCVAADEHRNDGSIGLEIDKNYSLYLLDKNTGEVFTKDIFSQIKITDNEFSDKKLVRKKATEGFNTHRQMTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQNVDKIFLL

SEQ ID NO: 436 - protein, 158 aa, Francisella tularensis
MIDFLLELDPCITIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLS

SEQ ID NO: 437 - protein, 878 aa, Francisella tularensis
MLNDLAGVLQVSRNQLLSSVEEWFQQAQRVGEISKSQDEQIFEWLKSFKIASYCKAAVEMQKQYRGTLKNAIQTAIFRQSENINKNKNKNKNTGNQQQALSENSKDVKSLTADEKKLLKLIENIAKASQKIGESLGLNDKQIKKFNSIYNFAQIQQIAFAERKGNANTCAVYSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSYKKYGTLNDEVNLICVTRDDNKNKGKRIFCLNDLANNYKLKQFETTDDLEIEKKIADTIWDASKQDFKFGNYRSFINLIPQEQKAFRYALFLADENSIKQAVIRAINNRNRTFVNGTQRYFAEVLANNIYLRAKKENLNTDKISFDYFGIPTIGNGRGIADIRQLYEKVDSDIQAYAKGDKPQASYSHLIDAMIAFCVAADEHRNDGSIGLEIDKNYSLYPLDKNTGEVFTKDIFSQIKITDNEFSDKKLVRKKATEGFNTHRQMTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSINKLHKKVRKDFSLPISTNEGKFLVKRKTWDNNFIYQILNDSDSRVDGTKPFIPAFDISKNEIVEAIIDSFTSKNIFWLPKNIELQKVDKIFLL

SEQ ID NO: 438 - protein, 292 aa, Francisella tularensis
MLNDLAGVLQVSRNQLLSSVEEWFQQAQRVGEISKSQDEQIFEWLKSFKIASYCKAAVEMQKQYRGTLKNAIQTAIFRQSENINKNKNKNTGNQQQALSENSKDVKSLTADEKKLLKLIENIAKASQKIGESLGLNDKQIKKFNSIYNFAQIQQIAFAERKGNANTCAVYSADNAHRMQQIKITELVEDNKDNIILSAKAQRLPAIPTRIVDGAVKKMVTILAKNIVDDNWQNIKQVLSAKHQLHIPIITESNAFEFEPALADVKGKSLKDRRKKALERISPENIFKDKNIC

SEQ ID NO: 439 - protein, 53 aa, Francisella tularensis
MNHSLLKSRYPDKVLEILKQSTIIEFESSGFNKTIKEMLGMTLAGIYNETSNN

SEQ ID NO: 440 - protein, 393 aa, Francisella tularensis
MNVKILPIAIDLDVKNTGVFSAFYQKGTSLEKLDNKNGKVYELSKDSYTLLMNNRTAQRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQNQEDKDHTQAYLHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 441 - protein, 1629 aa, Francisella tularensis
MNVKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSIKDRRKKALERISPENIFKDKNNRIKEFAKGISAYSGDNLASGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIVEIRQLYEKVDSDIQAYAKGDKPQASYSHLIDAMLAFCIAADEHRNDGSIGLEIDKNYSLYPLDKNTGEVFTKDIFSQIKITNNEFSDKKLVRKKATEGFNTHRQMTRDGIYAENYLPILIHKELDEVRKGYTWGNSEELKIHKGKKYDIQQLNNLVYCLKFIDKSISIDIQISTLEELRNILTTNNIATTAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 442 - protein, 285 aa, Francisella tularensis
MTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDKIFLL

SEQ ID NO: 443 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 444 - protein, 1367 aa, Unknown
  Fusobacterium sp. 3_1_36A2
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 445 - protein, 1367 aa, Unknown
  Fusobacterium sp. 3_1_27
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKIIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 446 - protein, 1367 aa, Unknown
  Fusobacterium sp. 1_1_41FAA
MKKQQFSDYYLGFDIGTNSVGWCVTDFNYNVLRFNKKDMWGSRLFDEAKTAAERRVQRNSRRRLKRRKWRLNLLEEIFSDEILKIDSNFFRRLKESSLWLEDKSSKEKFTLFNDDNYKDYDFYKQYPTIFHLRNELIKNPEKKDIRLVYLALHSIFKSRGHFLFEGQNLKDIKNFETLYNNLMAFLEDNDIYKNIDSSYIGNLENIICDSKKGLKDKEKEFKEIFNSDKQLVGFFKLSVGSSVSLNDLFDTDEYKKGEVEKEKISFREQIYEDDKPIYYSILGEKIEFLDIAKSFYDFMVLNNILADSQYISEAKVKLYDEHKRDLKNLKYIIRKYNKENYDKLFKDKNESNYSAYIGLNKEKGKKEVIEKSRLKIDDFAKIIKGYLPKAEKIDEKDRSIFNEILDKIELKTILPKQRISDNGTLPYQIHEAELEKILENQAKYYDFLNHEENGISTKDKLLMTFKFRIPYYVGPLNSYHKNKGGNSWIVRKEEGKILPWNFEQKVDIEKSAEEFIKRMTNKCTYLNGEDVIPKDSFLYSEYIILNELNKVQVNDEFLNKEIKKKIIEDLFKKSKKISEKNFREYLLVNQITNKTVELKGVKDAFNSNYVSYIKFKDIFGDKLNLDIYKEISEKSILWKCLYGDDKKIFEKKIKSVYGDILTKDEIKKINSFKFNTWGRLSEKLLTEIEFIDLETGECYSSVMDALRRTNYNLMELLSSKFTLQENIDNENKEVSEFSYRDLVEESYVSPSLKRAILQTLKIYEEIRKITGRIPKKVFIEMARGGDETMKNKKIPARQEQLKKLYDSCGKDISNFSIDIKEMKNSLNSYDNNSLRQKKLYLYYLQFGKCMYTGKEIDLNRLLQNNDTYDIDHIYPRSKVIKDDSFDNLVLVLKNENAEKSNEYPLKKEIQEKMKSFWKFLKEKNFISDEKYKRLTGKDEFELRGFMARQLVNVRQTTKEAGKILQQIEPEIKIVYSKAEIASSFREMFDFIKVRELNDTHHAKDAYLNIVAGNVYNTKFTEKPYRYLQEIKENYDVKKIYNYDIKNAWDKEKSLEIVKKNMEKNTVNITRFIKEEKGQLFDLNPIRKGETSNEIIAIKPKFYEGSTEKLNEKYGYYKSLNPAYFIYVEHKEKNKIIRSFERVNLVDVNKIKDEKSLIKYLIENKGLIEPKVIKKVYKRQVILINNFPYSIVALDSNKLMDFENLKPLFLERKYEKILKNAIKFLEDNQGKTEEYYKFLYLKKKDRNEKNETIDSVKERYNIEFNEMYDKFLEKLDSKDYKNYINNKKYSELVNVKEKFIKLNLFDKAFTLKSFLDLFNRKTMADFSKVGLTKYLGKIQKISSNVLSKNELHLLEESVTGLFVKKIKL

SEQ ID NO: 447 - protein, 1391 aa, Unknown
  Galbibacter sp. ck-I2-15
MKTILGLDLGTNSIGWALVKEAENENEVSDIIKLGVRVNPLTVDELTNFEGGKAYSNNAERTLKRGARRNLQRYKLRRENLIEILLKNGLINKDTALTEVGKETTHQTLKLRSKSANEKVSLEDLAKILLSINKKRGYKSSRKVNAEDDGVAIDGMEVAKLLYDENMTPGEYVLRLLESGKKHLPDFYRSDLQEEFNLVWKKQSEFYPLILTKELFFELHGKNKSQTWAICKEPLGIVGVKLKGSAKEQKFARYRLRKEALTQQIELEHLAIVLQDINNDSNKSSGYLGAISDRSKELFFNKETVGQYQYKQLQKDPNTSLKNQVFYRQDYLDEFEVIWRNQAKFYPQLTNELKQEIRDVVIFYQRKLKSQKNLISFCQFESTQQNYVEKETGKTKIRTIGRRVIPRSSPLFQEFKIWQSLNNLKFVNSESNQIIQFIELEDDVKKVVFDELNLRGDLKPNQVLKILSKYMKIGKLTQWKCNLEEIEGNRTNSALYNVFQMIAEEEGYGFNWGKKSALEIKSELKAIFSSIGINDSILDFDFSKKLDQQLSYQLWHLLYSAEEGNSKITEEDKFTYGNTGVALKKKLHLKFGFKPEYSTLISNLRFTSDYGNLSSKAISKILPFLRDGSDYSKACQYAGYNHSNSLSADELDNRELKPKLELLKKNSLRNPVVEKILNQMVNVVNQVIDNYGKPDEVRIELARELKKSAKERSQMTKNISDATRRNAEIKKYLSKEFGIPNPTKGDVIRYRLWEELASNGYKDLFRDKYIPKEKLFSNEIDIEHIIPKALLFDDSFSNKTLAFKVDNLKKADRTAFDFMSTDFSKDVDSYIGRIETLHKDGKISSSKYKKLMIPKSKLVDGFIERDLRNTQYIAKQARKMLLEVFKTVVPTTGKITDKLREDWDLINVMKELNFPKYKALGLTKKIERFDVGSEKIKSINVIEGWSKRNDHRHHAMDALAVAFTTHNHIQYLNYLNARKDIHHEMHGTIKSIENQIIGKDVMGKRRFIPPISDLRMKAKLQIESILISFKNKNKVVTWSVNKTKLKGKDNYNKRRQLTPRGQLHKETVYGKIKLIDPKPLKLNNKFTLVRASMIVDKVHREIVLQHLSKYDNNSEVAFDSKTIKIDPILIEGIGLKEVVCYEDVFKIRKKISGDNFKNEKHLEKVIDEKVKQILKDRVIKFQGNFKEAFSNLEENPIWLNKSKGIAVKSVAIKGVNNAESLHEGKDHFGDQILDKNKKQIPVDFVSTGNNHHVGIYEDKDGNLQERVVSFFEAVTRVNEGLPIIDKTYNSDIGWKFKFTMKQNEMFVFPSDDFDPNEFDLTDGKNAAKISPNLYRVQKIATKNYMFRHHLETVVTNDLEFTYKSIRSTGWLRNLVKVRINHLGEIVYVGEY

SEQ ID NO: 448 - protein, 1186 aa, Gardnerella vaginalis
MEGNISYAIGIDVGLNSVGLAAIRLDDYGEPIRILKAMSVIHDAGIDPNGAKESDTRKAISGVARRVRRLYRQRRRRLQKLDFLLQSLGWPVVENKDLDFSDSFIPWIFRAKLADEYIADEEQRKQMLSVAIRHIARHRGWRNPYQSIKSMMQETEYSEFYNELLKNIEKLAPGVGCEGSTPAQLVRDYLLSQQGKASRRLRITTGGRRKNHPHSLDPVLPRKLMQSDNMLEILNIFNVQHIDDKYVREQIINAVFYAESPRGSAENRVGKDAITGKGKRALKASLAFQKYRIISTISNLRIRENSKERCLTIEEKQNVYKLLTTSIDKSSKRKSAEAPLYTWIDVADCLGIERYKLRGVGSQIGDGESVGNRPPMLNSELAILYANNKSLGQSLITWWLASNRTQEDKEALIEILSNTVDIEAIHDNPEYQDKYGSAIAFIDSMNETEIAALENISLPDGRAAYSLETLDELNKQMLETDDDLFEARKKLFNLPNNWRPAEAPIAEPTGNPSVDRVLKIVHRFLISAKNRWGNPERINIEHVRSGFQSKKMANSYKELLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEQSTYCKNHDISADSAINRVRAFIFPPNSYDKRGANQFKKEVIARLKQKVGDEAFDNRSIESVAWMANELHRRIDWYYNSQNYQTNNGISDISNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYSNSSVHQYEVNALLKLHVGDEIDSETIRRSSTPALYCALTRNPDYDVNNGFPENPGRTILLHNKKLNADDSITFFKAQAVQLFVREGSAKIGNSIHHLRIYEYFEKLKSGKIKKSYGMIRVFQNDLHRHIHEDLFSCDLPEQSISMRYADTKVAHAVQTGNANYLGYLVPGDEIIVDFSHITLSENIGKFVEFLNKIGADCTAYRHWVVVGTDTEKVLILKPSMISSEGIDKLYSNCERNNFDYSSYEKSINEILAGKGWRVSVNVLAQYKAATIRRNALGEVRWASRSHLPISWSWDTGENRE

SEQ ID NO: 449 - protein, 1186 aa, Gardnerella vaginalis
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFIPWIFRAKLADEYIADEKQRKQMLSVAIRHIARHRGWRNPYQSIKSMTQETEYSEFYNELLKNIEKFAPGVGCEGSTPAQLVRDYLLLQQGKASRRLRITTDEKRKNHPNSLNPILPRKLMQSDNMLEILNIFNVQHIDDKYVREQIINAVFYAKSPRGSAENRVGKDAITGKGKRALKASLAFQKYRIISTISNLRIRENSKERCLTIEEKQSVYKLLTTSTDESSKEKSAEAPLYTWIDVADCLGIERYKLRGVGSQIGDGESVGNRPPMLNSELAIIYANNKSLGKSLLTWWLDANRTQEDKEALIEILSNTVDIEAIHDNPEYQDKYGSAIAFIDSMDETEIAALENISLPDGRAAYSLETLDKLNKQMLETDDDLFEARKKLFNLPNNWRPSEAPIAEPTGNPSVDRVLKIVHRFLISAKNRWGNPERINIEHVRSGFKSKKMANSYKELLDKRTKGKENLKAMMRNSLHLGMSDSISDADIRRYEAVQRQNGQCLYCGSEITYHTCELDHIVPRKGPGSTNTRENLVATCSLCNAQKCNTPFSTWCEQSTYCKNHDISVDSAINRVRAFIFPPNSYDKRGANQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYNNSSVHQYKVNALLKLHVGDEIDSGTIRRSSTPALYCALTRNPDYDVNNGLPENPNRAILLHDKKLNADDSITFFKAQAVQLFVREGSAEIGSSTHHLRIYEYFKKLKSGKIKKSYGMIRVFQNDLHRHIHEDLFSCDLPEQSISMRYADTEVAHAVQTGNSNYLGYLVPGDEIIVDFSHVKLSGNIGTFVEFLNKIGANCAAYNHWVVVGTDTEKVLILKPSMISSEGIDKLYSNCKRNNFDYSSYEKSINEILVGKGWRVSVNVLAKYNAETIRRNALGEVRWTSRSHLPISWSWNTGENRE

SEQ ID NO: 450 - protein, 1258 aa, Gemella haemolysans
MTEENPDIRKVFLAIHHILKNRGHFLLQGQSFKEGNLNNLIKELLNLDILHISIEITEENINKITEIALEKKTLTDKVNDLKKIYPKEKQLLEAFRLIFGGKTSLDKLFAIDEYKELDASVKSVSFKEKIYEEVRHDYEQVLSNYIELLDLAKLVYDSIILSDIKKEGKTLSESKVELYHKHREDLTKLKTLVKNDSKLSEDKKVELYSAIFKEDKDKGTNYVNYIRKSEEGKGCNYEDFKKFLVKELAKLEESSAKEEILRDLELELFLPLQRTKDNSVVPYQIHKEELVKILDNAAKYHKFLNEKDDSGYSIIEKVIQLLEFRIPYYVGPLNSSKKAKVDGFAWSVRNKGYENTPVTPWNYEKVIDESASAEKFITNLTNKCTYLKGEDVLPKSSLLYSEFALLNELNALKYDGNRISLEARNVIIEKLFKEQGKKVTKTSIKNLLKAEGYIDGKGEITGIDITVKNDLKSYRDFKKILGDKFNTEHVENIILWITLYGESRKLIKAKIEAVYGDIYSKEEIAKMSRLVYKDWGRFSRKLLTELVSKKLYNEETGECLNIIGAMRQNNILFMELLADRFDYSQQIIDYNKELQKEVTEITPEILDDLYVSPSVKRSIWQTVRIVEELKKIIGCAPAKIFVETTRSNQDKKKPTDSRKKQLELFYKAVKKDVKDLEKEIGSLNFDKLNERLSSVEPSKLKAKKLYLYYTQLGRCMYSGETIDITQLNTTAYDIDHIYPQSKVKDDSFTNTVLVKREYNAAKTDRYPLGSDIQTPSNRRFWKFLKEKGLITDEKYNRLVRTEEFSDEELTGFIARQLVETSQSVKAVAGILGELNPKTSICYSKAENVSSFRQNFGKIKEGNRKSDNTEQLIKVREINDYHHAKDAYLNVVVGNVYDTKFTRNVFNFIKDKKDGRKYSLNNVFYENVSNSNNVAWELNKTVHQVEKVMNNNNILVTRRTSEQKGGLFDATVYKAKVAAKAKEGVYYPLKTSDPVVNDVTKYGGFTKVKIAYYSIFEYTLVNKKGEEKITRIIPIPIYVSQNIKDDSTLLEFGKTQINIKSGEEVKDFKLKYRKLCIGDLVKINNFFNFIGGKTNDSFVYDGAVQVTLDTESERYIKTLSKYQNWKKENKDGELWESITKEKNTELYNLLVEKMNSGIFIKKKPNKFNELNSEEIRNNFSSISLEEQAKVLLEVLNLLTNKKSIFDLKSINITAARGKISFNLSNLSQFSIIEQSVAGFYEKEITIIGDKENDMENNNC

SEQ ID NO: 451 - protein, 1054 aa, Haemophilus parainfluenzae
MENKNLNYILGLDLGIASVGWAVVEIDEKENPLRLIDVGVRTFERAEVPKTGESLALSRRLARSARRLTQRRVARLKKAKRLLKSENILLSTDERLPHQVWQLRVEGLDHKLERQEWAAVLLHLIKHRGYLSQRKNESKSENKELGALLSGVDNNHKLLQQATYRSPAELAVKKFEVEEGHIRNQQGAYTHTFSRLDLLAEMELLFSRQQHFGNPFASEKLLENLTALLMWQKPALSGEAILKMLGKCTFEDEYKAAKNTYSAERFVWITKLNNLRIQENGLERALNDNERLALMEQPYDKNRLFYSQVRSILKLSDEAIFKGLRYSGEDKKAIETKAVLMEMKAYHQIRKVLEGNNLKAEWAELKANPTLLDEIGTAFSLYKTDEDISAYLAGKLSQPVLNALLENLSFDKFIQLSLKALYKLLPLMQQGLRYDEACREIYGDHYGKKTEENHHFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKKQRILSQKLDEKGFIERNLNDTRYVARFLCNFIADNMHLTGEGKRKVFASNGQITALLRSRWGLAKSREDNDRHHALDAVVVACSTVAMQQKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLKLKDLELMVNREREKDLYDTLKARLEAFNDDPAKAFAEPFIKKGGAIVKSVRVEQIQKSGVLVREGNGVADNASMVRVDVFTKGGKYFLVPIYTWQVAKGILPNKAATQYKDEEDWEVMDNSATFKFSLHPNDLVKLVTKKKTILGYFNGLNRATGNIDIKEHDLDKSKGKQGIFEGVGIKLALSFEKYQVDELGKNIRLCKPSKRQPVR

SEQ ID NO: 452 - protein, 1052 aa, Haemophilus parainfluenzae
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMIGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 453 - protein, 121 aa, Haemophilus pittmaniae
MLNRRYAAKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLN

SEQ ID NO: 454 - protein, 203 aa, Haemophilus pittmaniae
MVNREREKDLYDALKARLEAFNDDPAKAFAEPFIKKGGAIVKSVRVEQVQKSGVLVREGNGVADNASMVRVDVFTKDGKYFLVPIYTWQVAKGILPNKAATQYKDEEDWEVMDNSAIFKFSLHPNDLVKLVTKKKTILGYFNGLDRATGNIAIKEHDLEKSKAKGGIHQGVGIKLALSFEKYQIDELGKNIRLCNPSKCQSVR

SEQ ID NO: 455 - protein, 1052 aa, Haemophilus sputorum
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMTGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 456 - protein, 1338 aa, Helcococcus kunzii
MQDYYLGLDIGTNSVGWAVTDENYNLLRKKGKDLWGVRLFKEAQPATERRGHRSSRRRTIRKSLRKQLLRELFEEEINAIDKDFFLRLDESKYWLEDKKIEGKYSLFNDENFTDKDYYEKFPTIFHLRKALIESDDKEDIRLYFLAINQMMKRRGHFLIDGKLSNVEDITPFKECIQNLINEELDTEIETEFYDKAIKIVSDYSLKKTEKKNLIKDLVKETDSIEDSKKIINIFNLLISGKSKVNGIFDDEEILEKIKEDNKEDFYLTSEKYEENLEYFSQLLDYRFELISSLKSIYDYIILQEVLKGKKYLSYAQVERYKNHKEDLRKLKQLIKKYDKNGKIYYQIFRDENFKKGYVAYLGYYKKNKKNVPVKKCDYDTFSKNIKSTLDKICDKEDPLYIELIDKIEKGGFLLKQIVSTNSVIPHQVHELELDKILENLEKNYPSFKEISDGVSKIDKIKMIFNFRIPYYVGPLNDYHKDKVNSNTWIVKNEGFENENIRPWNFSKIVDEHACEEEFIKRMINECSYIPGEKVLPKSSLLYSEYMVLNELNNLRVNGDKLNPKIKKEIVENIYKKERKVTLKKIRNFLIINNYVDSKVEFSGLSDGIKANMSSYIDFAEILDDNFDNNMVEDLIEQITIHVGNVKLLTEKISNKYPNLEKKQINKIVNLKFKDWARFSRKLLVGIEGTEKETGEINTIIGFLRETNENFMELMSNRYTFSEEISEIKKKYIPNKLSKQIVDDLYVSPAVKKMIWQVLNINDELIKVLGKQPKKIFIEMARGKEEKPEVKDSRKNKLIELYKNLGKEGKEWLNRIEDKTEADFRNRALYLYYTQMGRCMYTGEIIDIERLYDKELYDLDHIIPRKMKKDDSIHKNLVLVTRNSNQYEKKDNYPVPEVIKSRENVRHLWYALKKKGLITEEKYNRLTRINPLSDKELSEFIERQLVETRQTTKVVKDLFENYYTDSKIVTVKAGLVSELRRDFEVLKCREINDLNHAHDAFLNIIVGDVWSKKFTSNPYNFVKKNREKYTLNNIFTKNQKDLRGNEIWNCAEGKKRIIKTLNKPSVLFSVENFEQTGQLFDQNIIGKQDYKEKTSYVPIKGDERLQDISKYGGYRGISGAYFFIVEHTEKNKRVKTIESLPIYMKSYVEENGLLDFCTNEMKLVDPKIIVKKLNYKSEIIVDGFKYLISGKTENRLSLETNEYLYWNHTQTTDIKKILNINEKIELEKYNGDIESERENIIKYIQIILEKFKLKPFIKRRNLPNIEINFADYETEKLLQLLVNLIPLTTKYVSPVDLTVISGSKYAGKVLIPKKISNLNEVIFISKSITGIYESRRRII

SEQ ID NO: 457 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRTPKDSLSAIEFIALSRTINTLINLSKESGEIYNRAIILQIVESTLKKGEISYKELREIIRLDERLRFKDPRLDYSREIKEAEKVKFLEFKQLKGFKKALGESFTTLARSQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNALLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLGKGQKGSKKHIAIVNGALTSTMRYYLGFASKDRDNHLHHALDAVIIGFMNDSVIKAFSDFKKTQETSKAAYYAHTLSKQEYKKQRAFIQLPSGENFRASVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDKNGVIKDWLEMDSSYEFIFSLYKDDLLLVQKKEMAEPELCYFMSFNSSIAQISVAKHDNNFSTLTKNQKLLFSNATQEDVSGKSIGIQNLQVFEKWQVSVLGEVKRTQSYPRENISLASKAKK

SEQ ID NO: 458 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFESKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 459 - protein, 344 aa, Helicobacter pullorum
MKILGFDIGIASIGWAFVENGELKDCGVRIFTKAENPKTGDSLAMPRREARSVRRRLARRKGRLETLKRLLAKEWDLCYEDYIAADGELPKAFMGKNLTNPYVLRYEALQRLLSKEELVRVVLHIAKHRGYGNKNAKITKSEESKREQGKILSALATNASVIARYRTVGEYFYKEFCEVIKNPQGLNTNENCTQPKVRVLKPIRNKGGEYTNCILQEDLQRELRCIFEHQKGFGFSITQEFQDKILKIAFYQRSLKDFSHLVGKCTFYPDEPRAPKFSLSAIEFITKAKAINLLASIAKESGEVWDKEQWRERLDSVFSAVCERGINTIPSSSHFLNIFDILYL

SEQ ID NO: 460 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 461 - protein, 1354 aa, Indibacter alkaliphilus
MKKILGLDLGTTSIGWAFIKEPEKDVVGSEIVDMGVRIVPLSSDEENDFAKGNTISINADRTLKRGARRNLQRFKQRRNALLETFKEKNLIPSNFQYAEDGPSSTFSTLKLRDKAAKEKIELDDFVKVLLQINKKRGYKSSRKAMSEEDEGTAIDSMGIAKELYENDLTPGQWVYEALKNGRKNVPDFYRSDLQEEFKKIVNYQSEFYPDILNTSFVEDWMGKASTPTKQYFNKRGVQLAENKGKREERRLQEYKWRAEAVNFKIDLSEIALILSQINSQISNSSGYLGAISDRSKELYFKNLTVGQYLYQQVKKNPHTRLKGQVFYRQDYLDEFEKIWSVQSSFYPQLNDELKQEVRDVTIFFQRRLKSQKHLISNCEFEEHHKVVPKSHPIFQEFRIWQNLNNLTLIKKDNLNEKCELALEDKTALANELAFKKELSVKDALKVLGLKPSDWEFNFTKIEGNRTNHAFFEAFAKIIELEDGEPIDLGNLKADDILDQFSEAFLRIGIDTELLQVNSDIEGAEYEKQSYIQFWHLLYSSEDDQKLKQNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPNLGRPDEIRVEMARELKANAEQRKNMTSNIASATRDHEKYREILKKEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEITMRVSVTTGTITDKLREDWGLVEIMKELNWEKYDKLGLTYTIEGKHGERLNKIKDWNKRNDHRHHAMDALTVALTKPAYIQYLNNLNAKAIGNKKGTEIFAIEQKYLKRENGKLCFIPPIENIRAEAKKHLSKILVSYKAKNKVVTINKNKTKKKAGFNEQTALTPRGQLHKETVYGKSFHYSTKFEKIGASFDAQKINTVAKKEEREALLKRLAENGNDPKKAFTGKNSLNKMPIYLDLGKNIKLSEKVKTVVLEQNYTIRKNIDPDLKVDKVIDVGIKRILESRLEEFGGNAKLAFSNLEENPIWLNKEKGIPIKRVKISGVSNVESLHVKKDHFGEKILDEEGNEIPVDFVSTGNNHHVAIYEDEDGNLQDEVVNFYEAVIRRNQGESIIKYRHEEGWNFLYSIKQNEFFVFPSQDFNPNDFDLLDPKNYDLISPNLYRAQKFSKVMYGNSAVRDYVFRHHLETVLNDVKELKDVAYKQLKSLQYLNGIKKVRLNHLGQIIQVGEY

SEQ ID NO: 462 - protein, 1397 aa, Joostella marina
MKKVLGLDLGTNSIGWALVNEATKEEKKEGKSSEIIKLGVRVNPLTVDEKTNFEKGRPLSTNADRTLKRSARRNLQRYKLRRRNLIEILIKNGFITKDTPLTETGKDTTHQTLKLRAKSAKEKVDLKDFAKILLTINKKRGYKSSRKVNSDEDGLAIDGMAVAKHLYEQNLTPGQYVLNLLQKNKKYVPDFYRSDLQEEFKNIWNNQKTYYFDILTDTLFEELKDKNKSQTWAICKKPFDIAGIKQIGKASDKRLERYKWRTEGLTQKLNLEYLAIALQEINNDINKSSGYLGAISDRSKELFFNKETVGENLYRQLVKTPHTSLRNQVFYRQDYLDEFETIWETQAKFYPQLTHTLKEEIRDVIIFYQRKLKSQKSLISFCQFESWEQTYIEKETGKSKTRTVGRKVIPKSSPLFQEFKIWQNLNSLEFRNSDEGEIIEFIKLDEDIRQTVFEELNLRGNLKPNDVLKILGNYISLGKVSQWKCNFEEIEGNRTNAALYNVYQIIAENEGYGFDWAKKTASEINKELKNIFPQLGIDASILDFDFTQANFDKQTSYQLWHLLYSAEEDFKISEEDKVLYGNSSVSLKKKLHQKYGFKPEYTKLLTNISLQPDYGNLSAKAICNILPYLKENNVYSEACDLTGYNHSNFLTAEEQAKRPLKPILELLKKNSLRNPVVEKILNQMVNVVNQVIETYGKPDEIRIELTRELKKSAKERANMTKSIADATRRNDDYRKTIIKEFGIPNPTKSDVVRYRLWQELASRGYKDIFTDTEIKPQELFSNKIDIEHIIPKALLFDDSFSNKTLAFKKDNLKKANRTAYDFIANDYAPNLENYIERVESLHKDRKITRAKRNKLLMLQSKLPDGFIERDLRNSQYITKEAKKMLYEVCRTVVSTSGSITDKLREDWDLINVMKELNFPKYKALGLTEKIERYDIGAEKMKEVEIIEDWNKRNDHRHHAIDALTVAFSTHSHIQYLNHLNARRDEGHKKHAAIIAIESTITEKEGNKKRRFIAPLPNFRLQAKEHIESILVSFKNKNKVVTNNINKTKRIKKDKFNTKVQLTPRGQLHKETIYGKIKQPLEKHIKLNKSFTLEQAKLIIDKRQREKVLNHLEKYAHNSDIAFNSKTLKKNPLLISDEPLKEVLCFEEVFTIRKDISYDNFKNEKQLDKVIDEKVKQALKERINQYNGDFREAFSDIERNPIWLNKAKGICVKRATIKGVSNAEPLHTAKNHLGEEVLTENKEQIPVDYVSTGNNHHVAIYEDEDGNLQEKVVSFYEAVIRVNEGLPIIDKEYNKSLGWTFKFTMKQNEMFVFPSEDFNPTEIDLLDQKNASLISPNLFRVQKFTIKDYFFRHHLETTVENNNTLKNTTWRREGLSGIYGIIKIRLNHLGEIVQVGEY

SEQ ID NO: 463 - protein, 1060 aa, Kingella kingae
MAAKSLNYILGLDLGIASCGWAVVEMDEQENPLRLIDVGVRTFEEAENPKDGSSLAETRRLARAQRRLISRRANRMNKLCRLLKQENVLQANDYDEKGLIIGLPNQAWELRAQGLDRKLEPKEWAAVLIHLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQGQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 464 - protein, 1314 aa, Lactobacillus animalis
MLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 465 - protein, 1371 aa, Lactobacillus buchneri
MKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDDSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 466 - protein, 315 aa, Lactobacillus casei
MFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAARGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDMVDCKINPNAVRTKKISFL

SEQ ID NO: 467 - protein, 236 aa, Lactobacillus casei
MFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAARGGVFAWMVRKDPDGNITPYNFDEKVDREASANTFIQRMKTTDTYLIGEDVLPKQSLLYQSYEVLNELNNVRVNDNKLSSSIFKSSATMITNS

SEQ ID NO: 468 - protein, 1389 aa, Lactobacillus casei
MIIRTYELKTITTIAILKMFQLLTGGLSMTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 469 - protein, 412 aa, Lactobacillus casei
MIKDNSLDNRVLVHPLVNREKDTIFASTRFAKQTNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNPKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKK

SEQ ID NO: 470 - protein, 234 aa, Lactobacillus casei
MKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 471 - protein, 566 aa, Lactobacillus casei
MQILTDEVLKQKIAELNAHELKASGIYAAIDDAYTSPSNKKALRQVLSVIDDITNAAGQAPNWLYIETADGDGVPGKRTNSRQRKIQEIYVNAAQELITSSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKK

SEQ ID NO: 472 - protein, 1363 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKMKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKVIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLTAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 473 - protein, 1360 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 474 - protein, 700 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKAIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLNAGMINSLANIRYRGWGQFSHKLLNELTLSTGRTVFEA

SEQ ID NO: 475 - protein, 330 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKNRYKYEKRLFNDRTDAEFYQQYPTMYHLRNRLLTDPSKADVREIYFAIHHILKSRGHFLTPGDAKDFNTNKVALNEIFPALQDAYAQVYPDLDITFDENKMNEFKTVLLNEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSQAKVDD

SEQ ID NO: 476 - protein, 330 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKNRYKYEKRLFNDRTDAEFYQQYPTMYHLRNRLLTDPSKADVREIYFAIHHILKSRGHFLTPGDAKDFNTNKVALNEIFPALQDAYAQVYPDLDITFDENKMNEFKTVLLNEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSHAKVDD

SEQ ID NO: 477 - protein, 1361 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGNTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 478 - protein, 1128 aa, Lactobacillus casei
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKDIQLIFMGAISERTRPILPL

SEQ ID NO: 479 - protein, 1366 aa, Lactobacillus casei
MTKLGKPYGIGVDIGSNSIGFAAVDENSHLIRLKGKTVIGARLFEEGKAAAYRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAKEGDRDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQAVYYDWLAAPNPVEKHRQSMTYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGEFEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 480 - protein, 1354 aa, Lactobacillus coryniformis
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 481 - protein, 544 aa, Lactobacillus crispatus
KYYLYFMQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 482 - protein, 298 aa, Lactobacillus crispatus
MDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKTSFQMNKNDQDFLF

SEQ ID NO: 483 - protein, 279 aa, Lactobacillus crispatus
MNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKYYTR

SEQ ID NO: 484 - protein, 538 aa, Lactobacillus crispatus
MQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 485 - protein, 206 aa, Lactobacillus crispatus
MQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKRK

SEQ ID NO: 486 - protein, 857 aa, Lactobacillus crispatus
MTKLNNEYMVGLDIGTNSCGWVATDFDNNILKMHGKRALGSHLFDEGVSAADRRAFRTTRRRIKRRKWRLKLLEEIFDEEMAKVDPNFFARLKESGLSPLDTRKNVSSIVFPTKKMDKQFYKKFPTIYHLRNALMKQDKKFDLRAIYIAIHHIVKYRGNFLSNSSISNFSASKIEIDRFVNELNDLYSIFLPESGVIFDAGNASKVEDIIRNEQMFKLDKIKEIADVLPDTENKSGLKLSKKISKEISKAILGYKAKFEIILQVNVDKTDSSIWNFKLNDENADVNLSEITSDLTDTQLQILDLVRNLFSAISLLNIVDEGSTLSESMIRKYNDHAQDLKLLKTVIKNHSDRKKAHNLQLAYDKYVNNRHFVDVETKKAFPNKHLYRKSDFYEIVKKNLDASKEAVQIRKEIALDKFMPKQRSDENGVIPFQLNQIELDKIIENQGKYYPFLKEINPIKAHRMQAPYKLDELIRFRVPYYVGPMIEPTNSSYPQTRQNQSFAWMVRKAKGRITPWNFDEKVDRQKSANNFIKRLTTKDTYLFGEDVLPANSLLYQKYTVLDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKTSFQMNKNDQDFLF

SEQ ID NO: 487 - protein, 857 aa, Lactobacillus crispatus
MTKLNNEYMVGLDIGTNSCGWVATDFDNNILKMHGKRALGSHLFDEGVSAADRRAFRTTRRRIKRRKWRLKLLEEIFDEEMAKVDPNFFARLKESGLSPLDTRKNVSSIVFPTKKMDKQFYKKFPTIYHLRNALMKQDKKFDLRAIYIAIHHIVKYRGNFLSNSSISNFSASKIEIDRFVNELNDLYSIFLPESGVIFDAGNASKVEDIIRNEQMFKLDKIKEIADVLPDTENKSGLKLSKKISKEISKAILGYKAKFEIILQVNVDKTDSSIWNFKLNDENADVNLSEITSDLTDTQLQILDLVRNLFSAISLLNIVDEGSTLSESMIRKYNDHAQDLKLLKTVIKNHSDRKKAHNLQLAYDKYVNNRHFVDVETKKAFPNKHLYRKSDFYEIVKKNLDASKEAVQIRKEIALDKFMPKQRSDENGVIPFQLNQIELDKIIENQGKYYPFLKEINPIKAHRMQAPYKLDELIRFRVPYYVGPMIEPTNSSYPQTRQNQSFAWMVRKAKGRITPWNFDEKVDRQKSANNFIKRLTTKDTYLFGEDVLPANSLLYQKYTVLDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKNSFQMNKNDQDFLF

SEQ ID NO: 488 - protein, 347 aa, Lactobacillus crispatus
MVNLKSLVLILKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 489 - protein, 534 aa, Lactobacillus crispatus
RDAYTDKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 490 - protein, 278 aa, Lactobacillus crispatus
SVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKYY

SEQ ID NO: 491 - protein, 277 aa, Lactobacillus crispatus
SVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKY

SEQ ID NO: 492 - protein, 1368 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPIDDTFFLRQKQSNLSPKDQRKLYTQTSLFNDRTDRAFYDDYPTIYHLRYRLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPGDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNSRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTRGVHENSGALFNQTLYAAKDDKASGQGGKQLIPAKQDRSTALYGGYSGKTVAYMCIVRIKNKKGDLYKVCGVETSWLAQLKQLTDEDSQKAFLEQKISPQFTKVKKQKGNIIEAVEEFEVIAPHILINQRFFDNGQELTLGSATYKHNEQELILDKTAVKLLNGALPLTQSEELAEQVYDEILDQVMHYFPLYDTNQFRAKLSTGKAAFMKLPWKSQWDGNKMVQVGQQVILDRILIGLHANAAMSDLKVLKMTTPFGMIQQSTGITLSADTQIIYQSPTGLFERRVALRDL

SEQ ID NO: 493 - protein, 669 aa, Lactobacillus delbrueckii
MAKPKDYTIGLDIGTNSVGWVVTDDQNNILRIKGKKAIGARLFTEGKVAAERRSFRTTRRRLSRRRWRIKMLEELFDEEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERNILSVQTLEELNDLFAENEGTEEVELNVASAEQINDILTGGHLNADSQKEISNLLLPSSFPSFDDKAKEKQVKKLINNVATNISKAWLGYKADFSTILNLAKVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVKKRHADLAKAMKLTGIKKRSELLDPEELKKGISSLLDDSPEAVEIKQRLEEKTFLPLQRSNNNGVIPNQLHQVELDEIIKKQSKYYPFLAEKNPDESEEAQKKAPTKLDALLTFRVPYYVGPMITKEEQEAQNGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQR

SEQ ID NO: 494 - protein, 544 aa, Lactobacillus delbrueckii
MTGCADYDVDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDFHHAIDAYLSTIVGNYLYQVYPNLRRMFVYGEFKKFSSNAEESAHDVARRVKSMNFLDDLLRGTHGDNIYCRSTGEIVFNRNDIISKLKQAYSFKQMLVTQEVFTKKSALFDQTVYPSPERDSKKRSGLIPRKKGMDTEIYGGYSGNKDAYFVLAEAVKEKGHTLQIVGVPIRALNTLKNSANYSEKLLEIIKPQVMFNKDTGKPIKGIKDVKILMDKIPCRQPVLEGESYYMLASSKYRYSLKQISLSQMSMKYILDYIDDPNFNKHEMINIDQQDEKECLLSVYDEILEKMDKYLPLFDIRSFRKKLHDGRDAFIALPVASEEKKPGEVDVIRKILKGLHANADITNLAELGFGTAALGALVSTGGIKISDDAVFIYQSPTGLFERRVKVSDLLK

SEQ ID NO: 495 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 496 - protein, 1313 aa, Lactobacillus fermentum
MHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIMKYRGHFLNNASVDKFKVGRIDFYKSFNVLNEAYEELQNGEGSFTIEPSKVEKIGQLLLDTKMRKLNRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKVSDVASLVMAKTRGVNKPSVEGLSDPKKFNSNLATYLDLKSIVGDKVDDNRYQTDLENIIEWRSVFEDGEIFADKLTEVEWLTDQQRSALVKKRYKGWGRLSKKLLTGIVDENGQRIIDLMWNTDQNFMQIVNQPVFKEQIDQLNQKAITNDGMTLREWVESVLDGAYTSPQNKKAIWQVVRVVEDIVKAVGNAPKSISIEFARNEGNKGEITRSRRTQLQKLFEDQAHELVKDTSLTEELEKAPDLSDRYYLYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKKRPVDLYGAYTNGTSAFMTIIKFTGNKPKYKVIGVPTTSAVGLKRVGKPGSESYNQELHRIIKSNPKVKKDFEIVVPHVSYSQLIVDDDCKFTLASDTYQHPATQLVLSKESMEIIADDFKFVKENTATADEQLVRVFDEIVNQMNHYFTIFDQRSNRQKVTKARDKFVSLPTESEYEGAKKTQVGKTEVITNLLMGLHANSAQGDLKVLGLSTFGFFQSSGGLNLSEDAMIVYQSPTGLFERRICLKDI

SEQ ID NO: 497 - protein, 1327 aa, Lactobacillus florum
MTEQQQPYNIGLDIGTSSIGWAVTDQNDKLLHIRGHNGIGVRLFKEGESAAERRGFRTTRRRLSRRRWRLRFLDRIFDAELAKVDPNFLARLKQSNISPLDPNKQMFGNILFDDPQFDDQKFHQQYPTIYHLRSALAQPDAPQADVRLIYLALHHMIKFRGHFLNGAAVEKFHGGQLHLESEFQELNQIFSNQQRDHVQLQTSSLDEVATILKDNQRTPSDRQRELSARLFVPVDKTIDKENKKLATELLKAVLGLKAKFDVILGVEATDPQAFKLQFSSDDFDDKIAELASELTDEANEILTVLQRLYFSLNLADILTNRQTKQVADSISTAMINRYDDHKHHLKMLKELEAQVTQEQRDGLKKAYDEYIDGDKPTIDTFYTNIKKNLDDSELANQIKSLIDLQAFMPKQRSKENGSIPHQLHQRELDQLIEVQGKYYPWLLAAKDKLDALIAFRVPYYVGPMIDPNQSDDPQNTKFAWMVRKEAGEITPWNFEEKVDKTSSATNFIKRMTTTDTYLLGEPVLPKNSLLYQQFTVLNELNKLKVNGKALTVDQKKYLYEHVCKKQRRVTLKKLSDCLMARGDFPMGAIFTGTTDQKNMNNTLKTYQDFQEIFGDEIDNPDRQVDFEKMIEWSAIFEDREIFKLKLAELNWLTSEQLERVSKKRYQGWGRLSQKLLTHIVNENGERIIDQLWNTNQNFMEIMGQDSVKQAIQEHNGANVAQTGINETIDELYTSPQNKKAIRQILLVVDDIKKAVGYAPANIMMEFAREDRDDHRLIASRARQLEKTYQEISKNWFDNESVTQELKDQIKNKTKFTDRLYLYFIQGGIDLYTGHPLNIDQLSSYDIDHILPQSFLLDNSLNNRVLTSQAENRVHKEDRLPGETVANKMRPTWKMMREQGLMTQRKYNNLTLKPDQISKFNNRGQFINRQLVETRQVIKLAADIMSQKYQADQTKVVTVKANLTHHMREKFNFYKSRNVNDYHHAFDAYLTLFVGNWLLKEYPKLQPYFVYGDFAKTGTNNLKSFNFLYRFERDHKLNDKGAIDTDKDQQLGYMKRIYRFKKMLVTKQLETNEGALYGQTLYPAPKNDKKTRNLINSKKNRPSDIYGGYSNENGSFLTLVKLKKGSKYDYRLVAVPVSKISEIKESELATIEKAIAPQFLKSSGKYRDFQVVLSKILINQKVIDDGMIFTIGSKSYKHNAKQVVLSDNSIQIVSTLSRISDKEKLITVFDEIVDITSKYLPWYKVNDVEKTKMLFRQMQDIDEMKKIIDNSLIGLHCNASITDLGKVGLSKYWGRFVLTAGISLTVDAQLIYQSPTGLFEHRVKVSDL

SEQ ID NO: 498 - protein, 1386 aa, Lactobacillus hominis
MTKITEDYIVGLDIGTNSCGWVAMDSKNTILRMHGKTAIGSHLFDAGNSAADRRAFRTTRRRIKRRKWRLKLLEEIFDSHLAKVDPYFFARLKESGLSPLDTRKNVSSIIYPTSLEDKKFYVDNPTIYHLRYKLMTEDRKFDLREVYLAIHHIVKYRGNFLYNTPVKAFEASKIDVKGSLKKLNELYEGLDSEFNVELDSNNALEIENIIRDKKIFKINKVKEINQLLSLKTEDKERTKLMKDVSKQIVNAILGYKTKFETILLKDVSKDEADDWEFKLTDVDADNKFENLIGDLNENEQEILLVIRKLANAITLSNIVEEGKTLSESMKDKYKKHSDDLKLLKQVISDHPDRDKAKKLALAYDLYVNNRHGKILQAKDILEKKKTLSKEDFYKEIKKNLDDSKESQEILDAISLDSFMPKQRTNENGVIPYQLHQLELDKIIENQGKYYPFLKEVNPVSSHLKQAPYKLDELIRFRVPYYVGPLISPNESTKNKQTKKNQNFAWMIRKEQGQITPWNFDQKVDRMASANKFIKRMTTIDTYLLGEDVLPANSLLYQKFTVLNELNNVKINGKRISVPLKQELYNNLFKKNSTVTTNKLKSYLKENYKLIKVEIKGLSDEKKFNSGLTTYNKLKNLKIFDQQIDDPNYNKDFERIIEWSTIFEDKAIYKEKLKTIDWLSDRQIDKLSKIRMQGWGQLSKKLLSQLTDNNGQTIIEQLWDSQNNFMQIVNQADFKDAIAVANQNLLVDTSVEDILNEAYTSPANKKAIRQVVKVVDDIVKATSGKVPKQIAIEFTRDADDNAKISQSRANKLRKVYKEMSNELASETIRNELERVAKDQKLLKDKHYLYFMQLGRDAYTGELIDIDNLEQYDIDHVLPQSFIKDDSLENRVLVKKAVNNGKSDNVPVKLYGNRMATDLGMTIRHMWEKWKEQGLITKTKYNNLIIDPDKINKYESSGFIHRQLVETSQIIKLVSTILQSKYPDTEIIVVKARYNHYLRKRLNLYKSREVNDYHHAIDAYLSAICGNLLYQVYPYLRPFFVYGQYKKFSSEPEKEKIIYDKTRRYNFISQIFENKDNDIISRETKKKVFDKKDIIEKLKRAYNYKYMLVSRETETHDQEMFKMTVYPRLSRDTKKSRNLIPKKKDMPTEIYGGYTNNSDAYMIIARINKKKGPEYRVFGVPMRELVNLRKAEKNGHYKAYLKQVLEPEIMYSKNGKKNKTISSFEIVKAKVPYKQVILDGDKKFMLASSTYVQNAKQLTLSQYSMQAITDNCENDTEEEKALVEAYDEILTNIDKYLPLFDINKFREKLHAGREKFVDLPLAEKKETILQVLNGLHDNAVMPKIKSLGLSTPLGFMQFHTGVSLSENAKLIYQSPTGLFEKRLKISDL

SEQ ID NO: 499 - protein, 270 aa, Lactobacillus iners
MITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKYLIINLNIMTFC

SEQ ID NO: 500 - protein, 255 aa, Lactobacillus iners
MITYLKDNDDITLSFPKDQLINIFKNSNLNSTEKSDQLKPFFGRTNLEKGIIKLLSGGKQDLSNMFRDETLKNSNYKNLKFSDNTFDDERDGYAADLGDRINLLILLKQIYDASILESMMSQARVSIDGHKYISSAKVCAYEKHKSDLKRLKSLIKKYLPSEYNNIFRKITEKDNYVAYSKSNITNNKREKALKYVEYVDFTKYLTKKLKTIKTQDAEDDKEIFEIKGELEKQSFLPKQRTLDNSIIPYQLHLME

SEQ ID NO: 501 - protein, 343 aa, Lactobacillus iners
MLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKIDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKYKIDEINKSYYQHDKFNYKSMIDSLYVSPATKRILWQSLKVVHEISKIMKHDPEKIFYRNGTFQRRSS

SEQ ID NO: 502 - protein, 447 aa, Lactobacillus iners
MLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDSKTNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVISKYTNSVFGKSMLISDKYRKDIFKSVDKSILEFNSLNTIAKADNLLKFVTSMRPAGSVDALKMVGLIERIRKSNVISNFNEFKLINQSVTGLFENEEDLLKL

SEQ ID NO: 503 - protein, 667 aa, Lactobacillus iners
MQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 504 - protein, 1395 aa, Lactobacillus jensenii; identical to SEQ ID NO: 113

SEQ ID NO: 505 - protein, 1382 aa, Lactobacillus mucosae
MDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 506 - protein, 1382 aa, Lactobacillus pentosus
MKKIVNYNLGLDIGTSSIGYAAIDDQGRPVRHQNKTVMGVRLFKEGKTAESTRIFRGTRRRLSHRHWRLGYLDRIFDNEIAKVDENFLPRLKASKRARSDEKRSFRGSLLFPETGDDAYYQKYPTIYHLRYALITQKKQFDIRLIYLALHHMIKYRGNFLDTTPVSAFNIHDIDLTDQFASLNDCYQLLDMDFEFQFDLNNIEQVQKLLLDETLSKTKRQAAVSKVLVMSTGNKAFDDQQNGIASEFIKALLGGPFDLSKILNLSVADVKSWKLHMTDKDVDDTLNSLVEELDENHKQIVNLLQMIYSQVMMLGLLNGQQSISASMIERYDDHAKHWAALKKLLPALGEQEQSTIIHAYTAYTGHSRTKQLSRAEFYTKVNSILKKHENIAEATGLIELIDRNEFMPKQRDAVNGVIPHQLHQRELQLIIQNQQKYYPFLAAKAYPDADETMIEQLLSFRVPYYAGPLVDRDFINESSDQEQAMQNTKFSWLKRREAGEITPWNFEQKVDVQETANRFIKRLTTKDTYLMTEDVLPKESLIYQRFEVLNELNAIRINDRRLTAENKQLAFQQLFMAGNTKNVSIKKFRNFVFDSLKFPEKVKITGFAGQHNFLAKLSTYHDFKKIFGERVDHTDLQPDFERIVEWCTIFEDRHIYREKLKEIQWLSQSEIDQLVLIRNHGWGRLSKRLLTGIRDSDGRTVMDQLWFGTDNFMRIISQSDFAAAIANENRTQLNQHGLEDVLDSAFMSPQNKKAIRQVLKVVDDIEQTLGCPPKKVMIEFTRSPDKKKQRTVTRLEKVQQAYKAVADQLAGQSIVSELDQYANTHSKLSDTYYLYFMQLGRDLYSGKPIDIDSPMLDDDHILPRAFMKDNSLDNRALTEKPINNTKAAKFPSKVFGQQKEVTDFWKLLRRCGLMSNIKEKHLYLDPDNVDKWTRRGFIHRQLVETSQVIKIVANILNDRYQQSQTEVLEVPARLGTELRECFGWYKVREVNDYHHVFDAYLAAFIGNYLYRRYPKLQPYFVYGNFAELNKAQLKNIKSFNFLYNITDNKRVVKDIETGQTLWDDQIRQQIQHIYEYKYMLTSHEAFTQHKELYGQTIYPRREFKPGTLKAIKQDQPQELYGGYKNLTAAYMCIVKIQARKRRAAEYRVVRVATESLSALQQAKRLGVQAYERCLRQELVRNNEILRTNADPNSAPREFEVLLDRVLCHQMIISDGQKYLLGSHAYKINCMQLVLSNNSMKILSTSIVKLKQMTNEPLVQVYREILDVVNKYFTLYDVNSFRENLNQFFDKFRTLPITNEYESSKSGKKLIHRGQLETLTLILRGLHANSDKVQYGDQSTLLGGFQTKDGIKLSKDSVIQYTSPAGLNVRTVKLRDLEQKEAQK

SEQ ID NO: 507 - protein, 1361 aa, Lactobacillus pentosus
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKAYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYRKTPQITGLADPKGFNSSLSTYHDFKKILLEAIADEHKRADIEKIILWSTTFEDSAIFKQKLEEVAWLTDAQRKQLSGLRYRGWGQLSHKLLTAFKDDKGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASYNKSKTLVPKKNHMETSVYGGYSNQETAYLAIVRIPFKSGFKFIVVGIPTRMVAKIKHYQSLGATLNQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVASQAHQSFEGLKNNVQTSDKQLGKKEVLNSLFVGLHANATRSNLSVLGMSKDFGRIKSNGITLTDQAEIIYQSPTGLFERKVALKDL

SEQ ID NO: 508 - protein, 1358 aa, Lactobacillus pentosus
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDQEFYHDYPTIYHLRDKLMTSDRKFDIREIYLAIHHIVKYRGNFLRTGPASQYGSASLHLATSFQKLNDLFAQSEESLNFKLVTDEAQLQQIQQILVRTDLSRSEQQRQIWPLMVVLMGATAAEKKRQKDFAKELANALVGLKAKLNVVTLTNVDTTVVKDWTFTLEESQDKLPEIEEQLSEVGQQIMDEVIQLYASVNLAQLIPAGKRFSQHMVEKYNHHEKNLELLKAYIHSQSDSKRGREIRATYDRYIDGVKSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDQKLAPRQKQRLYNQVFKQHQHVSVKNIQQNLMDAGEYRETPKITGLADPKGFNSSLSTYHDFKKILPEAIADEHKRADIEKIILWSTTFEDSAIFKQKLEEVAWLTDAQRKQLSGLRYRGWGQLSHKLLTAFKDDNGRSVMDGLWETSDNFMQLRKQPAIETQIKEANQANLTDADIQDTINELYTSPQNKKAIREVMLVLDDIKNAMHGQTPSWIFIEAARGGGVAGRRTQSRSKQIVEAYKSTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPSASIVAVKANLTHQFRQTFNFPKLREVNDYHHAFDASLTAFIGMYLLKQYPKLERFFVYGKFAKQPINLTRFNVIRKLAVAEEPIANIETGEILWDKTADIKCFEKLYNYKRLLVTHEVRENYGAMFDQTIFKATDSRKRLIQKKKGFATETYGGYTGRTLAYLAIVKVVTNKDTQYQVVGIPTTMVTQIQQLEASGLTSKQAVTKAIGAMINENNKKLQSYEVLLPKVRFEQVVRDEVKGHIHRFALGTDTYYHNIQELYLPLTIQRAFLGKRNDTDAQTEQNLLTVFETTLAQVNRYFPLYEMNKFKQILNSAQEKFAALPTKNKTVKNKLVTGKDGVLNNLFIGLHANASLGDLKILGMKIGFGKLQVPGGLKLTDQAEIIYQSPTGLFERKVALKDL

SEQ ID NO: 509 - protein, 1358 aa, Lactobacillus plantarum
MKEPYGVGLDIGTNSVGWTVVDASGHVRKIKGQTGIGVRLFKEGAAAADRRGFRTTRRRLKRVKWRLRLLREFFDQPISKVDINFFARRKYSDVSPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIISNQKEYYPWLGEENPVIKRRGKFPYKLDELFGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAREFPTAPRITGLADPKVFNSSLSTYHDLKQVLPEAMSDVRKQADIEKIILWSTIFEDSTIFKQKLTEISWLTAAQLKQLGQLRYRGWGQLLRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVRDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKIDFGKLQVPGGIKLTGDAEIIYQSPTGLFERKIALKDL

SEQ ID NO: 510 - protein, 1361 aa, Lactobacillus rhamnosus
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQEHYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 511 - protein, 1361 aa, Lactobacillus rhamnosus
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 512 - protein, 1352 aa, Lactobacillus ruminis
MNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 513 - protein, 1339 aa, Lactobacillus salivarius
MERYHIGLDIGTSSIGWAVIGDDFKIKKKKGKNLIGTRLFNEGATAAERRGFRTQRRRLNRRKWRLKLLEEIFDPYMAEVDEYFFARLKSSNLSPKDSNKKYLGSLLFPDKSDSNFYDKYPTIYHLRRDLMEKDEKFDLREIYLAIHHIVKYRGNFLEKVPAKNYKNSGASIGFLLEEVNSLYKDIIGDESIAILNSEKFEDVEKIILDEETRNLDKQKSVGKLLVEDKKKKNIVTAFSKAIFGYKFNIEDLLLIENDEKNKLTFNDENIDDIFNELSHSLDDKQMDLLTKTREIYFKFKLNMIVPTGYTLSESMIEKYEMHKAHLKMYKEFINTLNTKDRKILKNAYSDYINTEKAKAANAQENFYKTVKKIIKDNNSDTAKKIIVLIDEGNFMPKQRTGENGVIPHQLHQIELDRIIENQAKYYPWLAEANPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKFKVLNELNNIKVNEKKLDIEQKQDIYLNLFTTAKNVTKKSLATYLNCSADSISGLSDGEKFNSSLSSYIDLKAILGNIVDDCNKNEDLEKIIEYSTVFEDGNIYKEKLSEISWLTDEQIEKLSNIHFKGWGRLSKKLLTQITNENGERIIDALWNTSNNFMQIINDESIQAKLAEINGKYAGKSDLEDILSEAYTSPQNKKAIRQVMKVVEDIEKAMQCEPTSISIEFTRKKQKSRLTNTRYKKISDVYEKIADEVISEYELRKLQSELDSNANNMRDRYYLYFMQLGRDMYTGEKINIDELHQRYDIDHILPQSFIKDDSINNRVLTRKDVNNKEKSDKTAADLYAVEMSDFWRKLRKQGLITEQKYKNLLTKSDSIDKYAKKGFIKRQLVETSQVVKLVANILQDKYSDTKIIEVRAKLNSNLREEYKLIKNRAVNDYHHAIDGYLTTFIGQYLYKTYPKLRSYFVYNDFKKLDSNYLKHMKKFNFLWQLQDDKTIDIYDNVNNKFVLNVPEMKKYIQKIYNYKYMLVSKEVTTKNGAFYDQTKYNAKTVNLIPIKKNKPTNIYGGYKGKVSSYMMLVKIRKKKEVIYKFVGVPRLWTDELDRLKDTTERKILLNEIAKNSLSKTEQDFEVILDKVYYGQLIIDGNQKYTLGSSEYKYNAMQLHLSKHALEVLAKENVKDAEITDKDLVSVYEEILSVVNKYFELYDINKFRQKLNEGLEIFRKLPVYNVYESNKIKQVGKFEVLNRILMGLHANAMITDLKVLGIKTKLGQMQVNGGIKLSPDAKLIYQSPTGIFSRAVRVKDLG

SEQ ID NO: 514 - protein, 629 aa, Lactobacillus salivarius
MERYHIGLDIGTSSIGWAVTGDDFKIKRKKGKNLIGTRLFKEGNTAAERRGFRTQRRRLNRRKWRLKLLEEIFDPYMAEVDEYFFARLKDSNLSPKDSNKKYLGSLLFPDISDSNFYDKYPTIYHLRRDLMEKDEKFDLREIYLAIHHIVKYRGNFLENVPAKNYKNSGASIGFLLEEVNNLYKDIVGDENVTILNSEKFEDVEKIILDDGIRNLDKQKGVGKLLVEDKKNKNLVTAFSKAIFGYKFNIEDLLLVEGDEKSKLTFNDENIDDIFNELSHSLDDRRMDLLTKTREIYFKFKLNMIVPTGYTLSESMIEKYEIHKAHLKMYKEFINTLNSKDRKILKNAYTDYINNEKAKAANAQENFYKTVKKTIKDNDSDIVKKIIDLIDEGNFMPKQRTGENGVIPHQLHQIELDRIIENQAKYYPWLAEENPVEKNRKFAKYKLDELVTFRVPYYVGPLVDKTESNKNEKETKFAWMVRKSKGTITPWNFENLVDRTESANRFIKRMTSKDTYIIGEDVLPASSLLYEKFKVLNELNNIKVNEKKLDIEQKQNIYLKLFTTTKNVTKKNLATFLNCSIESISGLSDDKKFNSSLSSYIDLKVILGDIVDDYSKNEDLEKIIEYSTIF

SEQ ID NO: 515 - protein, 897 aa, Lactobacillus salivarius
  misc_feature (822)..(822): Xaa can be any naturally occurring amino acid
  MISC_FEATURE (822)..(822)
  misc_feature (823)..(823): Xaa can be any naturally occurring amino acid
MLIESDEKNKLTFNDENIDDIFNELSHSLDDNQMDLLTKTREIYFKFKLNMIVPTGYTLSESMIEKYEMHKAHLKMYKEFINTLNAKDRKILKNAYSDYINNEKAKAANAQENFYKTIKKTIKDNNSDTAKKIIGLIDEGNFMPKQRTGENGVIPHQLHQIELDRIIENQAKYYPWLAEENPVEKNRKFAKYKLDELVTFRVPYYVGPLVDKTESNKNEKETKFAWMVRKAKGTITPWNFENLVDRTESANRFIKRMTSKDTYIIGEDVLPASSLLYEKFKVLNELNNIKVNKKKLDVEQKQHVYLDLFTTRKNVTKDNLATSLNCDVESITGLSDNEKFNSSLSSYIDLKAILGNAVDDCNKNKDLEKIIEYSTIFEDGNIYKEKLSEISWLTDEQIEKLSNIHFKGWGRLSKKLLTQITNENGERIIDALWNTSNNFIQIISDESIQAKLAEINGEYADKSNLEDILDEAYTSPQNKKAIRQVMKVVEDIEKAMKCKPTSIAIEFTRRKGKSKLTNTRYKKISETYEKITDELISEYELGKLQSKLDSKANNMRDIYYLYFMQLGRDMYTGEKINIDELHQYYDIDHIFPRSFIKDNSLNNRVLTRKEINNNEKADRTAADLYAVKMGDFWRKLRKQGLITEKKYKNLLTRTDSIDKYTKQSFIKRQLVETSQVVKMAANILQDKYSNTKIIEVRARLNSDLRKEYELIKNREVNDYHHAIDGYLTIFIGQYLYKTYPKLRSYFVYDDFKKLDSNYLKHMDKFNFIWKLEDKKAEDVYDNVNNEFILNVPKMKDYIQKIYNYKYMLISKEVTTESGAFYXXTKYNAKTINLIPIKKDKPTNIYGGYKGKVSSYMMLVKIQKKKEVIYKFVGVPRLWTDELDRLIDTDEKKALLKK

SEQ ID NO: 516 - protein, 1419 aa, Unknown
  Lactobacillus sp. 66c
MAKPQNYTIGLDIGTNSVGWTVTDDQNNILRIKSKKAIGARLFEEGKVAAERRSFRTTRRRLSRRKWRIKLLEELFDEEISKVDPNFFARSHESWISPKDKRERYSAIVFPTPEEDKKFHNEYPTIYHLRDRLMKDDQKHDIREIYVAIHHIMKYRGNFLHDESIETYRSGMSSLGGGDERTILNTKILDDLNDAFADNLATQGISVNSASADQINEIVTSGHLNVDSQKAIAKLLLPTTLSSDDKKQDKKIKKLATDAAKNVASAWLGYKANFAAILNIQEVDKDKKKIYSFALQGADEEDKVETLESVLSQDQIEIVDRIIRIRHAIVLGEIIPVGMTLSEAMIEKYDQHAKDLKNLKTVIRNLKDRKNAVKLQAIYDLYVNNRHADTAKAMKLAGVKKRTELLEPEEFNKSIEKLLDDSPVSAEIKKRIAEKDFLPLQRSNSNGVIPNQLHQIELDEIIKKQSKYYPFLGETNEHASADVARKAPTKLDQLLTFRVPYYVGPLITKEEQEEQDGHSFAWMIRKNPKDHEKITPWNFDEKVDRMASATQFIKRMTTKDTYLLGEDVLPSSSLKYQLFTVLNELNNLRINHKKLTREEKEQVIEDLFKKYKTVKADKFKNYWQKGHAGLDVKIQGMADPEKFNSTMSTYIDLQKIFGDQLDDAQRQNDFEKIIEYSTIFEDRKILGEKLRADFVWLSEDQIKRLCRLRLQGWGRLSLKLLTRLTDADGQNVLERLLNSNDNFMQIVKDPVIKAKIEQKNQKLLRADWSENATESILDEAYTSPQNKKAIRQVMRVVHDIVKACDGNLPAKFAIEFARSQDDDPKRTVARADRLQKIYAQISDEVVSQGVKDQLSGMKSLKDRYYLYFMQGGRDAYTGKPLNIDRLSDYDIDHIMPQSFIKDDSLDNRVLVTRAVNNQKSDNVPVLLYGNHLVADLGITIREMWDRWQKSGMISKRKLANLLTDPATLSEYRAEGFINRQLVETSQVIKLTATILQSEFPDSKIIEVPAKYNSILRKQFDLYKSREVNDYHHAIDAYLSTIVGNYLYQVYPNLRRLFVYGEFKKFSHGEEESSHQAVRRVKSMNFLDDLLRGKHGDDIYCRVTGEVIFSRKDIISKLKQAYSFKQMLVTQEVFTKKSALFDQTVYPSPARDSKTRSGLIPRKQGMDTEIYGGYSGNKDAYFVLAQVVKSKGHTLQVVGVPIRALRALANCSNYSEQLLKIVKAQVLFNKKTGKAKKGISDVRILLDKIPYRQPVLDGSAFYMLGSSTYKYNLKQISLSQQSMKYILDYIDDPNFNKHEMTKIDQQNEKECLLSVYDEILDKMDKYLSLYDINGFRKKLHVGRDKFIKLEVEKQAEAIKNVLRGFHANSDMTKLSDLGLSTSLGFMQASDGIKLSDNAVFIYQSPTGLFERRVKVSDLLK

SEQ ID NO: 517 - protein, 1289 aa, Lactobacillus versmoldensis
MRRRYRRRRNRLNWLDELFADELAKIDPSFLLRMKNSWVSKKESTRKRDPYNLFIDEKYNDVDYFNQYPTIFHLRKELITEDKKVDIRLIYLAIHNIIKYRGNFTLENQNFDISQLSSNFSQQISDFFALFSDFGVIMPEDFDPDKISDILLNPNLSPSGKVSEAIATISPKTNVKAKIKIILLLLVGNNGDLKKLFDLETTEKIAVKLSSRHIDSELPIILSELNEQQENIITIANSIFGSIILKDFLGDETSISAAKVISFEDHKQDLQKLKTMWRETSNKEAVKAGKKAYEDYIGHEDSETFYKKIKKFLEKAQPVDLANKALAEIELENYLPKQRNRNNTVIPYQLNENELIAILDHQEKYYPFLKENRDKILSLLTFRIPYYVGPLQDSNNNRFSWMTRKASGAIRPWNFSEKVNVEQSSNDFIKRMRSTDTYLIGEPVLPKKSLIYQCYEVLSELNNTRVKDGSSNPKRLDVTIKQRIYNEIFKNQKSVSVKVLQNWLIKESYFKSPEISGLADKKKYLSSLSTYIDFKKIFGQRFVDDPVNSPQLEELAEWLTLFEDKKILLIKLQNSKYSYDQATINKLSTMRYQGTGKLSKKLLVDLKTTKKSIGKSGAESLSILDLMWSTKDNFMQIIHDADYTFEQQIKEFNYDTEDELTPLEKVANLHGSPALKRGLNQSIKVVADIVKFMGHDPEKIFIEFTRSDDFSKLTISRYRRIKKQYLEIAKAIKKIPAEFKDIKEYQTQLEENKGKLASERLMLYFLQCGHSLYSNKPIDLNMINSSKYHVDHILPQSYIKDDSLENKALVLASENENKIDNMLISHDIIATNLPRWQALKDQNLMGSKKFADLTRTTVTENQKKGFIQRQLVQTSQIVKNITLILNDLYKNTSCIETRATLSSEFRKAFSNFDETTYHYQFPEFVKNRDVNDFHHAQDAFLACVIGEYQLKKYPKDNLRLVYDQYSKFLDSLKKDTRKKNGRMPRYTQNGFIIGSMFNGKTYVDDNGEIIWDQKIKESIRKTFNYHQFNVVRQTIEQHGKLFNDTIQPHSDRYKLIPLKTNRDPAIYGGYNNDNNAYSVVLDVDGKKKINGIPIRIANQLKSDELDLSSWLENNIKHKKPMTILIDKVPKYQRIINEETGDLLITSANEVINNVQLFLPSMYTALISLLDSTKTEMYSKLLSNYEANILIDIYDYLLTKLKNNYPLYRKEWAKLAEHRDDFIESDLVTQASTLQQLIKFMHADPSNVNLKFGNFKGNRFGRKNGNIKLSKTDFIYESPTGLFKSIKHID

SEQ ID NO: 518 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKNFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGGSSDKTLEQAIEKQNIQWEEKFQRIINASMNICPYKGASIGGQGEIDHIYPRSLSKKHFGVIFNSEANLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 519 - protein, 907 aa, Leptospira inadai
MAKSIEEIRSIQNEFVVEYSILLKKIKKGEIDKKNDVYKVYQNTIKSSERLEQVLKERLGFQNVSKSYFNNPYSIAQLYNLISVDRSGFSKVCRSCQEENHWRSTLIDTDRGPQAQASKQVSDTGRPFDGQLAMLLDRIAFEIVKLKRIEIERLLSNKNSSKIEVVEIPLLIEENSFNFRYELAELKKLSKKKKDQLKKSVEEFDTKLNSKQERIKAASRELCPYTGKKISKGEIDHILPRSWTQKQFGTALNAEANLIYASREGNQSKGNREYGLNDLDEKYLNIIFGTKEVDSIQRNISDTIDRLDIERGTTRIVFDRLAPNERDCLRHALFIKSLRPKVFELLSGQLKARVNGTQLYLAKRIRSLLLKNQDFITKSLIIKVPSFSFYEPRTVDLPYMRKELAEKFPNLGKQNPQPTGSHIIDAAMVMAYAVETDSGNLSFGSKDKSEGFDSESLSRFLPSNIQFLSIKSKDKTDSKYPYKKPLFKDGVFGERFLPILIAEKGLRVGYTLENSLEVNSENPEEFFNVLKPYLLFKRKPIESNYQTLVAFAQKDKRGYIVLPVNKPKALESISQRKSDPHTSILKNILYTVSRESIPSLIFDKNTLIPEIKSNKVNWGDKLEKKFRIKIEIKLYGKKIADGFIRYPGKTEWEKLLLTEPLKGLVKNKTLTPKWFDSLENLAGLDDHFKDTSNPEAKHKRKSNHYALPVPKGPSGGFRIRRNSFDGYKVYQLYSVDGNSFHAFKIENGWTGKTLLLDIYQNSGNLHSLDYDYENTDISQTALFSKFYKIEFSKEETQKINSKGIKSLYVAPGSSSRQYIRVIFDKQTFSKFIKFQSKFWEFDLITPLPKDKAKDLIESILKIFPEDLRPKKPRNDIHIQNISHDSVQVEYIADGKTQGFGQYFINQN

SEQ ID NO: 520 - protein, 418 aa, Leptospira inadai
MILKSPIAIDLGAKNTGIVYTTYQPNALPTEIHGATIISDNLKLSQVDRRAKRHQRRNYTRMKLARRLVYLIIRYHYRIPEQDLTPEVKTSLQSLLTRRGYTFQSIETEGNELGQAPWGEIEDYFPNVQDYEKSLPIQTVLYHFFSSENLELNKLVPSKEPETKEDKNILKYIREQKEAFESEQNNGARHRLKYFEEIKEDFPRKIKLMECLQKNKIEEKKFLNLIQNISNLQIKPLRAYFNDKDMKEKEIWEPRRLHTYIARWIRSWHIDPKNSSKRLIRQKLLSQLENGKLKIIRDTSIYSPSKDIISFLEEIDPKDTIPPYEDQNNRHPPRCQNLWLDGKILDRYFPGWEQSLWKLIRNEKNNPFEQLITKDFRTDDTISEGKSLSEQIQIYERSHSNIKLDVRAVILQRFLDRS

SEQ ID NO: 521 - protein, 125 aa, Leptospira inadai
MSAYDRSANLDPWSLRLQGKAKKEIKTTESLSKTDLQKASDAYEKIKEILSESDTDQFIKLANRYYLEVADIKKGMWLPTAPERKHKEIPKSIAHEENQDISLFHKCNTKTGSKKRISQVSLEMF

SEQ ID NO: 522 - protein, 1355 aa, Leuconostoc gelidum
MTYSIGLDIGTGSVGWAVIGDDYRLKRAKGKNLIGVRLFDSATTAAERRGYRTTRRRLSRRHWRLRLLNDIFASDLAEQDENFLPRLKYSWVNPDDEQNPQLNSDVANGALFGSSETDKAFHKNYPTIYHLRHELMTDTAKHDLREVYLAIHHIVKYRGNFLNTADKINAENSFNVDLFIAALDEYNEFLETPITSIKDAQLFSDKLTDINARNKSVRVENAMSETYDDKSKIFKAILTALVGNTANFQTIFDLSDLEKDEAKNFKFKLDLEDVETKLDVVRAKLSDEQNAFLEAVLIAYDGITLKMILGDYKSISQSMIESYKSHQRDWKYIKNNVRLNEQKIEPDKNSVKFFKLDPKKLIYPSNLAYLQVISSNEDEHRKGLDYFKTAIQDADILQRIENDTFLPRQRTKRNGVLPYQLHLAELEQIIKKQSKYYPFLANIYTQDNKTENKLIGLLKFRVPYYVGPLVEAEKVTGDGKNHWLIKKELQENTPITPFNFDDVVDKDKSGEQFIKRITGTDSYLIGEPTLPENSLLYQKYNVLQELNNVRNERHQRLPIKVKQDIFEHVFKIDKNVNAKKVMAYLKLNGYGDFQIAGLSDTRTGKFNSNLSSYNYFVDLLGREKTEKIREDRLEEIIEIQTVFEDKILVAKRLSNLDFLTPQEKSKLSAKHYTGWGRLSQKLLTTQFIKTALSEAGDIIPQSHSIIDLLYYTDKNLMEILNDKTFNVRNWLTEQNKGTESGNSLYDQIDALAGPKDIKRGITQVFSIIDDIKKAMGSNPETVYLEFARETQTSRLTNSRLNRVQEIYNSPELKTEFAYLAKKLEAETKESIHDDRLYLYYLQEGRDMYTGKEIPFDQISSNYDIDHIIPQAFTKDDSLDNRVLVNRATNARKSNSPTFTNDIIDNRKSWWQSLVKRGLMSKEKFERLTDKRKTFSENQTNHFIARQLVETRQIIKNVADLIKNNYDGTQAVAIRASLTGEMRRYLDWPKNRDMNDYHHAHDALMMATVGKYVDRRGFFDNGSVSDGAGNAYNLYTKDWLVAARVGTRNDSQRVNPYGFIVGSMNSKAVRQQVNKETGEIVWGNENLDYLRHVLSYKKILVTRRLSGSSGRLYAETLFSPNPKAKLIAQKANRSVALYGGFTKAESAYTALVEFNKKGDRSYKLIKVPMAIANRVNDKQITVTAYIASLNLRDFSRVVLEHLPLGTLIRESDGSEFYAASSEYKHNAKELWAPKEILRSSKKLDKATADNLIDIFDFLTNDKTISNFKFYEKDLLHLKNVRDKFVEASDEIKIKVLSDVIYELHNDAGWRDPFKHIQEKPAWTMLQVKGGIKLSEKAAIVYQSPTGLFETITIVGE

SEQ ID NO: 523 - protein, 883 aa, Leuconostoc pseudomesenteroides
MIGVRLFEGADTAAERRGYRTTRRRLSRRRWRLRLLNDIFASELSKIDENFLPRLKYSWVNKNDTDNVHFGVGVFDNSEQEKAFYQDYPTIYHLRQKLMTDNRQHDLREVYLAIHHIVKYRGHFLNSGEISANSSFDAQKFLELLREFDNTFYPDAVKFLNLDQLDLPDKISSEISDSKISKSERVDRVLQHVQLANSGAKKILKAILNAVVGNSVDSVAMFSLSDLDKEEKKKINHPVTDSKPFKYSDKEVEAKLDELSNLLQDEQKIEFLSLLKLSFDGLTLKMLLGNAKSVSEAMVERYKVHKDDLKFIKENILNSFSKDKKKEFDKYYEAHLAEKDVDNVDKYFKKIIDDSIISKDKKIELLQKIDDHDFLPSQRSKINGAIPHQLHRNELDKIISQQSKYYPFLADSYTQNGKTETKLAGLVNFRVPYYVGPLVSKENADRNNPDGGQNHWVEFKENTSLSNLTPWNFNEIVDKDKSAAKFIERLTGMDTYLIGEPTLPQNSLLYQKYNVLQELNNIRVDNHKLDVKIKQDVFEHLFKTQNSVSAKDVKNYLIANGYAAPSIQITGLSDTNEKTFNSKLSSYNYLVDKLGRTFVESVKSDVLEKIIELQTVFEDKTVLLRQLSMISELTLAQANQLAEKHWTGWGRLSRKLLSSKVVDVNKITNSTFYPATSRQTIIDTLYHTQLNLMEIINNAEDLYGVRQWISEQNKSDSSDTNDVYDQIQELAGDKKIKRGITQSFRILDDIVKAMGGEPERVYLEFARENQQSGVSFSRKNLLSKLYENDSLKQTFKELKSQLESETKENLQNDRLYLYYLQQGRDMYSNDELNIDQLSSYDIDHIIPQAYTKDNSFDNRVLVSSKANRLKRMLLWYPVKLSKK

SEQ ID NO: 524 - protein, 468 aa, Leuconostoc pseudomesenteroides
MKDQGFISKRKFENLTRRGDFSEQQKERFIARALVETRQIIVNVSSLIDSHFNHTKAVAVKSNMTTDMRHYTKVPKNRDINDYHHAHDALFVATVGQYIENKGFMKAGKLSDSVGNEYNRYTKKWIETARKNTNYGRVNPFGFVVGSMQTATRGKLDYETGELKVVKNNYWSKDDLDYLLKVVSYKKILVTTKLQDNKGAMYDANLISAKGSGKKKAQLQISKSKNIDLYGGFNKLQNEYSVLILNHDEYRWLSIPMYARNSSEQYLHDKYPDAKVILNHILVGQPILLSNSSDPQKSKFASLRIATGGDYHNNFEFVPSVDVKKILDNIYLNHSVTDDEYKKVFESLLATLHDKFVFGIHQVMYNKIFDNKYLFDKMPDEAKRNVINSLLKFMNISKNQLGAVGKIGGKVNGVLYGFKTETEKGTSAGQLISNGKMQPHDIFIFQSPTGIFERRVTVAELANVIKDE

SEQ ID NO: 525 - protein, 1103 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 526 - protein, 1337 aa, Listeria innocua
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 527 - protein, 953 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 528 - protein, 232 aa, Listeria ivanovii
MMSKLILGLDIGISSVGWGVLDESTNEVVDAGVRLFEEATRNGNEDRRGFRSARRLKRRRQHRLERAKGLIENNGFSCTDINKFNPYQARYNAIFGEVTKDELAAALFHLVKRRGTTIDAPEEEVKDVENELSTKMQLEKNAKKLATKYDYICEIQLEKLKENKVVRDHENRFRTEDYVKEARAILENQQEYYPEVTNEFIESYMALIETRRMYYDGPGSEKSPTPYGQYFI

SEQ ID NO: 529 - protein, 300 aa, Listeria monocytogenes
DDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHD

SEQ ID NO: 530 - protein, 782 aa, Listeria monocytogenes
  MISC_FEATURE (722)..(722): Xaa can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 531 - protein, 1334 aa, Listeria monocytogenes; identical to SEQ ID NO: 109

SEQ ID NO: 532 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 533 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 534 - protein, 1099 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGIPAN

SEQ ID NO: 535 - protein, 1334 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 536 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 537 - protein, 874 aa, Listeria seeligeri; identical to SEQ ID NO: 175

SEQ ID NO: 538 - protein, 1087 aa, Listeriaceae bacterium
MKKLVLGLDIGVASVGWGIIDAENGDVVDTGVRLFSSRDASENESRRTSRQSRRLSRRKKHRRERIKQLLLAHDMDICDIVNENPYELRVKGLNEKLEVSEIYVALTHLAKRRGVSYLDDVVEEGGTIKSEHLNKNMEEIKSGKMPCEIQLERFEKYGQVRGMIEINQDTEESSFLVNIFRTSDYIKEAKTILATQQKFHKQITNEFIDEYIHIMASKRDYFIGPGNEKSRTDYGVYRTNGDTWDNLFEILIGKCSVFPEETRAARSSYVAQEFNLLNDLNNLKISNLESGKLSASQKHDIVEKVKNSKKFGTKDLLKYIASVCECKIEDIGGCRVDKNRKPIMHTFENYRKVHNALNEAGVDLRLSETDYDELMKIMTLNSETLEIKKQCKEKLPQLTEDYLNVCLVLNKKGAFSGWHALSLKAMKLMMPELYGTSKNQMQIIHTMQLGKAYLKPLNQQKYLNSEAILEEIYNPIAARSIRQTIKVTNAILKKYGHLDSVIIEMPRDYQTSEDERKMIEKMQKENEKEKKAALKRAREEYPFPDEAFRNHKELATKLRLWYQQDQFCVYSGRKISVVDLVRNPNQFEIDHIIPQSVSLDDSLNNKVLCFSEENQKKGQQTPFYYHKGKSGNWTYEQYKLFVEKLFDKKKISNKKRELLLFEEDINKWDVRRGFIARNLVDTRYASRVILNSYQQYFGNHEMGTKVKVVRGKFTSQLRKKWRIFKDRNESHSHHAIDALIVAATANLRLWKKNTLGVSDEGKVYDKETGEILPFEKLTESEYNEMMNKEPYLNFKTKLQNIETKVKYSYRVSKKVNRKISDATIYSTRERDGIDYIVGKIKNIYDVKTYKDQFLKRYKKNKEQFLMYQHDPQTFAILENIMATYQDAENPFLAYKKEYGVIRKYSKKGGGSPVTSLKFIDKVLGQKIDLTAKNQAALPKNKKVVLQSITPYRADVYYDEIDKRYHLIGVKYSLFSFSKQGYVINPIAYQKLLEKEQIHSEMKFCFSLYREDIIEFGEDPDSLTRYRFWSKNESGKNKIEVKPIEKPNFEKQTVLTITKKIKILNKYQTDVLGNSFKAQEEKDPRNIE

SEQ ID NO: 539 - protein, 1345 aa, Unknown
  Marinilabilia sp. AK2
MKKILGLDLGTTSIGWAFIKEPEKDVVGSEIVDMGVRIVALSSDEENDFAKGNTISINADRTLKRGARRNLQRFKLRRDALLEIFKEMKLIPSNFKYAEDGPSSTFSTLKLRDKAAKEKIELDDLVKVLLQINKKRGYRSSRKAKSEEDDGSAIDSMGIAKELYENDLTPGQWVFEALQKGRKNVPDFYRSDLQEEFKKIVNYQSEFYPDVLNSSFVEDWMGKASTPTKQYFNKKGVHLAENKGKREERRLQEYNWRAVAVNSKIDLSEIALILSQINSQISNSSGYLGAISDRSKELYFKNQTVGQYLYQQIKINPHTRLKGQVFYRQDYLDEFEKIWSVQSGFHPQLNDALKKEIRDITIFFQRRLKSQKHLISNCEFEDYHKVVPKSHPIFQEFRIWQNLNNLTLIKKDNLNEKSELALEDKIALANELAFKREQSVKDALNILGLKSSEWEFNFTKIEGNRTNHAFFEAFAKIIEIEDGEPLDLGNLKADDILDQFSEAFLRIGIDPGLLQVNNDIEGPNYEKQPYIQFWHLLYSSEDDQKLKQNLIKKFGFKPDHAKILASISLQDDHASLSSRAIKKILPHLQSGLIYDKACTYAGYNHSSSFTKEENEKRELSSELDLLKKNSLRNPVVEKILNQMINVVNAILKDPNLGKPDEIRVEMARELKANAEQRKNMTSNIASATRDHEKYREILKKEFGLKRVTKNDLLRYKLWLETDGISLYTGKPIEASKLFSKEYDIEHIIPKTRLFDDSFSNKTICERQLNIDKANVTAFSFLQNKLSGDEFEQYQSRVKSLFGKLSKAKIQKLLMANDKIPEDFIARQLQETRYISKKAKEILFEITRRVSVTTGTITDKLREDWGLVEIMKELNWEKYDKLGLTYTIEGKHGERLNKIKDWSKRNDHRHHAMDALTVALTKPAYIQYLNNLNAKELNGKKSTEIFAIEQKYLKRENGKLCFIPPVENIRTEAKKHLSKVLISYKAKNKVVTINKNRTNKKAGFNEQIALTPRGQLHKETVYGKAFHYSTKFEKIGASFDVQKINAVAKKEEREALLKRLAENGDDPKKAFTGKNSLSKMPIYLDLKRNIKLPEKVKTVVLEQNYTIRKNIDPDLKLDKVIDVGVKRILENRLKEFGGNAKLALSNLDENPIWLNKEKGITIKRVKISGVSNVESLHVKKDHFGEPILDQVGNEIPVDFVSTGNNHHVAIYEDEKGNLQEEVVSFFEAVVRQNQGLPIINKNHSLGWKFLFTLKQNEYFVFPSDDFDPTDVDLMDEENYHLISPNLFRVQKFTTKDYFFRHHLETTVEDKSELKGVSFKRLGLPGLNCIKKIRINHLGKIIQVGEY

SEQ ID NO: 540 - protein, 1091 aa, Mobiluncus mulieris
MDSRKYRVGIDVGTNSVGFAAVEEDDSGSPTRFLNTMVVIHDSGVDSEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 541 - protein, 1233 aa, Mycoplasma canis
MEKKRKVTLGFDLGIASIGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTNANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNELLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISTNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNPDTSKTPKRLMFGIKSIMNNYEQVDISPFGINKKIFE

SEQ ID NO: 542 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTIESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTSANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDAILPKLLDNNEGWNLEAIKNYDEEIKSQIEDNSFLMAKQDKKYLNDNFLKDAILPPNVKVTFQQAILIFNKIIQKFSKDFEIDKVVIELAREMTQDQENDALKGIAKAQKSKKSLVEERLEANNIDKSVFNEKYEKLIYKIFLWISQDFKDPYTGAKISANEIVDNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDDKKMFKVIAMNGAVTSFIRKNMSYDNKLRLKNRNDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKLSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 543 - protein, 1233 aa, Mycoplasma canis; identical to SEQ ID NO: 242

SEQ ID NO: 544 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEENAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKSHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGMAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDKFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 545 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMLSVEDIDMIKYEWAGKEPNVYGVGLSGLNIEESAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFDDKYEKLIYKIFLWISQDFKDPYTGAKISANEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 546 - protein, 1239 aa, Mycoplasma cynos
MEEKRKVTLGFDLGVASVGWAIVDSETNEVYKLGSRLFDIPDTNIDRRAKRGSRRLVRRRSYRNQKFYNLIKRTKTFGFLDKEAIEKEFVLLSIKYPNIIELKVKGLQEEVSKSEAVWILHDYLKNRGYFYDDKEEKDDLENPSIESMPSYKLYEFYKEYGYFKGALSSPTESEKNKDSDLEKAIFFNFSNKEWTKEINHFFKIQKNIFSEDFKAKFMEFFSFIRDISKGPGSENMPSQYSIFGKYGDDGMGGKYQHIWDKNIGKCSIFKDKVRAPKYLPSALFFNLLNELSNIRLYSVDKREKSVLWRLSSKDKINIILNILQIILFKNDGKISNLDINKIVKNESIKSIILNEIDLDLIKDMWFEKEPNVYGIGLSGLNIEENKKENRFKFQDLKIFSVFIDLLKKSNINIEFNNEKDIIHNLKLLDELYFFLITQKYSRDKYGSIKKFILNNKSFNIDNLDEKLNIFLSISDDEFDNHNSKTHSLSKEAIYFIFPKLLHNNEGWNLEAIKNYDIDVREEISKHSFGIKKQDKKYLDDAFLDDAILPPSVKVTIKQSILIFNKIIKKFSNKFQIDNVVIELAREMTQEKEMDAQKSLNRLKKSRKKIIEERLNANNIDSKMFRDKTGEISPNYIYKIYLWISQNFKDPYTGENISANDILKNNVEIDHIIPYSLCFDDSSSNKVLVFKHSNQSKGNFLPFDMISTFSENSVWNWKEYTQYVEKTFKTNLESILDKKERVKKADNLLTSSYDGYDKLGFLARNLNDTRYATILFRDQLINYSENHLIDSKKMFKVIAMNGGVTSFIRKNMSFDSGLKVKDRSIFSHHAYDAAIIALFSNKTKILYNLINPSLDGIISKRSEGYWVLEDRLTGEIRKLNYNDWQSIKNNVEVKKIAREIESHLSNLDNVVMFSRKSKRKTNKELYNETLYGIATRIDENGIKNYYKKEKFNILEDENIYLRLLNERENFIINRSNPEVIDAIIEIFETIDKNKIPARDVAKNIKYTDNKIKYNLYLKDYMRKLVDEFPDKFRKDFIEQMIAKKIFILFNPIKNTTRKIKSLRSINNNKIEDIRKKQVLEKFNTAKNEPRSFYESLNSLGAIIFKNNLNIYKKMSISSQIATFGDKNWKIDDINTYNKEKLNKYKEIYGIDETYDFYSFIFPGTILLDEKNKEFLYISSIQTLKDKIELKFLDRIEFEKKNVNSNLKPKIKREIISTKKLMSDYKIIKISPLGINKKIFE

SEQ ID NO: 547 - protein, 1269 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKKKKANRFLMTLSTILNDYILLDAKDNFDILGLSKNRIDEILNSKLGLDKITK

SEQ ID NO: 548 - protein, 1224 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKRRKQIGS

SEQ ID NO: 549 - protein, 1269 aa, Mycoplasma gallisepticum; identical to SEQ ID NO: 133

SEQ ID NO: 550 - protein, 226 aa, Mycoplasma iowae
MSNKKKITIGLDIGVSSVGWSILREDNVLIDYGSRLFPDAANAKDGKLENEARRSHRSMRRRIRRIKTRKNDLIKLLIKYNIISDQDELAKILEQGIVNETGNVPIVEIKYKGLKEKLSKEELLICLYHYIHKRGYFYITEEDLKENGENINRLPTEIQYDFYMKNGYYIGNEDNQKFSNLIWVKEIEKFLSKQSLDSNFVDEYISLFRRVRDYSDGPGSEKSPTP

SEQ ID NO: 551 - protein, 1304 aa, Mycoplasma synoviae
MLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 552 - protein, 1401 aa, Myroides injenensis
MKRILGLDLGTTSIGWAYVHEAENVNETSSIQKVGVRVNPLTTEEQTNFEKGKPITTNASRTLARSARRNLQRYKLRRDNLIQILKENNWINNTTSLTETGNHSTFETYELRNKAASEKLTLDQLSRVLLMLNKKRGYKSSRKVNSKEEGQLIDGMEVAKKLYHEQLTPGQLSLQLMNQGVKKLPDYYRSDLNQELESIWNFQQQFYPNILTDKFKEEINGKGLTSTSSAFWNIYNFNTAENKGSRDEKKKQALQWRSEALSKQLSKEIVAYIIADLNGQIYNSSGYLGAISDRSKELYFNNLTVGQYLFKQLKSNPHTSLKNQVFYRQDYLNEFEKIWETQSKFYPKELTAALKREIRDVIIFYQRKLKSQKGLISFCEFEQKQKTINGKTKTIGHRVIPKSSPLFQEFKIWQQLHNVVLRNKKTNEIVSLADEQKVHLFEELNLKGKLKSNQVLKLIENKPKDWELNYTELEGNNTNKALYNAYLDILDIEGYDVRNELKVKLNKDDIELSDLDVNASEIKEMIFSVFKHLGINTEILEFDATLEDKVFEKQASYQLWHLLYSYEEDNSPTGLDRLYNLLHKKFGFKLNHAKLIGNVLFQDDYGSLSSKAIKNIFPYITENNYYTACELAGYKHSKHSLTKEENETRELKNRLTILPKNSLRNPVVEKIINQMINVVNTLIDEENNILIAQGKEPNFQFDEIRIELARELKKNAKEREELTKSINKSKTDHEKIIKILQKEDGIKNPTRNDIVRFKLYSELKNNGYKDLYTNEYIERKDIFTKEYDIEHIIPQSKLFDDSFSNKTLVRRNVNLKKGNQTAYDFILCEYGQEKANEFETRITNLYNLGKDEGISKSKFKKLLMQESEIGNGFIERDLRETQYIAKKAKSLLLEITRNVISTSGSITDRLREDWGLINVMKELNLQKYRDAGLTEFVKMKDGNKKEVIIDWTKRNDHRHHAMDALTIAFTKHNHIQYLNHLNARKNVNNELHNNIIAIEKLETTLVSDERGNKKRIFKEPIANFRTIAKSHLEAILVSHKAKNKVVTKNINKISGKKISQQTLTPRGQLHKETIYGKIRQYVSKQEKVGPKFTIEVIEQVSNPTYRNLLLKRLEENNNDPKKAFGGKNSLNKNPIYINLEKNIKVPEVLKLVWLEDNYTIRKEISPDLKIDKVIDQGVKQILQNRLAQYKGDSKLAFSNLDANPIWLNEDKGIAIKRVTISGIATAQPLHRKKDHLGQPILDHNGQEIPVDFISTGNNHHVAIYEDENGKLQESVVSHFEAVERVNQKLPIIDKTFNQHLGWKFLFTMKQNELFLFPSDDFNPNEIDLFDKQNYTVISKHLFRIQKLSTKDYSFRHHLETNVEEIKDLKTITWRREGLNGIQNIIKVRTNHLGEIIHIGEY

SEQ ID NO: 553 - protein, 1466 aa, Myroides odoratus
MKNILGLDLGTNSIGWALVKEDFENKQGEILGLGSRIIPMSQDILGEFGRGNSISQTADRTGYRGVRRLRERHLLRRERLHRVLNILGFLPNHYAKEIDFTKRLGKFINHAEPKLSFDKEFIFKDSFNEMLKDFQQNQPGFIINKHGEEALVPYDWTIYYLRKKALTQKIDKEELAWILLNFNQKRGYYQLRGEEEEENTNKLVEFYSLKIIDVIADNEVNKKGEVWYSLHLENGWIYRRSSKISLVDWKDKVRDFIVTTDVNDDGSEKLDKDGVVKRSFRAPSADDWTLLKKKTEQDIDNSNKTVGAYIYENLLLNPKQKIKGKLVRTIERKFYKDELKQILEKQKEFHQELQNEQLLQDCVRELYKYNEQHQQMLESKDFVHLFLNDIIFYQRPLRSQKSLISNCTLEKRVSRDGVVFPIKVISKSNPYYQEFRLLQWLQNLAIYRKDDDVNVTQEFLNSIESWENLLQFLNAKKEIKQEQLIKFLLEQKGLKGNSLKTAILTYRWNYVTDKVYPMNETRSLIQDKLKKVENVATDFLSFDNEMALWHIIYSVNDKIEYEKALAKFASKHNLDEISFVESFKKFPPFKSDYGSFSEKAIKKLLPLMRFGSVWNKNNIVPSVLDRIDKILTGEYDEKIKIRVREKAEQFQLNQIEDFQNLPLWLAQYVVYDRHSEAEIAGKWNSVKDLENYLKEFKQHSLRNPIVEQIITETLRVVKDIWQQYGNGVQNFFDEIHIELGREMKNTADERKRITNSVTENENTNLRIKALLVELKEDTNIENVRPHSPMQQEILKIYEEGVLNAVENIDEDILKISKTAQPSKSELIRYKLWLEQKYQSPYTGEMIPLSRLFTSDYEIEHVIPQSRYFDDSLSNKVICEAAVNKRKDNQLGLEFIKNHHSEKIELGNGRTAQVLEVEAYESFVKKNYDKNRGKRNKLLLEDVPEKMIERQLNDTRYISKFVTHLLSNIVRKDEVNSKDDGINSKNIIPGNGKITSQLKQDWGLNDVWNELILPRFERMNNLTNSTDFTSTNTNGKIIPTVPLEYSKGFSKKRIDHRHHALDALVIALATRDHVNLLNNESALPKKDRTKEEQKSFRFDLQVNLRNKEKYFNVKEGREKEKFTTFKKPWNTLTQDTRDALENMVVSFKQNLRVINKATNYYESYTDENGNLRLDKYGNPKKELISQKGTNWAIRKSLHKETVSGQIHLDRVKVTKGKIVTATRKSLDSSFNEKSIESITDTGIQKILRNYLKAKDNKPDVAFSPEGIEELNKSISVYNEGKNHQPIIKVRIFEQGSKFPVGETGNKIAKFVEAAKGTNLFFGIYQDKTGKRSYDTIPLNLVIERLKQGLSPVPETNEKGHQLLFHLSPNDLVYVPTIDDNEQLDSNRVYKFTDSSDTTCNFIPSNISAIIFNINSKEQEKRGINYPIQNELGVGSPQSKNQKSFDGFMIKEVCIKLKVDRLGNISKT

SEQ ID NO: 554 - protein, 241 aa, Neisseria lactamica
MAAFKPNPMNYILGLDIGIASVGWAMVEIDKEENPIRLIDLGVRVFERAEMPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHVSDGLKEGIETLLMA

SEQ ID NO: 555 - protein, 666 aa, Neisseria lactamica
MAAFKPNPMNYILGLDIGIASVGWAMVEVDEEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLVKHRGYLSQRKNEGETADKELGALLKGVADNAHALQTGDFRTPAELALNKFEKESGHIRNQRGDYSHTFSRKDLQAELNLLFEKQKEFGNPHVSDGLKEDIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKNNGFCCKNSMKKDLKNAT

SEQ ID NO: 556 - protein, 828 aa, Neisseria lactamica
MLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYGKKNTEEKIYLPPIPADEIRNPVVLRALSQARKVINAVVRRYDSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTSEKLRTLLAEKLSSRPEAVHEYVTPLFVSRAPNRKMSGQGHMETVKSAKRLDEGISVLRVPLTQLKLKDLEKMVNREREPKLYDALKAQLETHKDDPAKAFAEPFYKYDKAGSRTQQVKAVRIEQVQKTGVWVRNHNGIADNATMVRVDVFEKGGKYYLVPIYSWQVAKGILPDRAVVAFKDEEDWTVMDDSFEFRFVLYANDLIKAELKKETFFGYFSGLDRSTGNISLRSHDLDKTKGKDGVYRIGIKTALSFQKHQIDELGKEIRPCRLKKRPPVR

SEQ ID NO: 557 - protein, 408 aa, Neisseria lactamica
MNDTRYVNRFLCQFVADHILLTGKGKRRVFASNGQITNLLRGFWGLRKVRTENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDDPAKAFAEPFYKYDKAGSRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKTKSTNSAKKSDHAV

SEQ ID NO: 558 - protein, 1082 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 559 - protein, 976 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGIFAG

SEQ ID NO: 560 - protein, 1081 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVADNAHALQTGDFRTPAELALNKFEKESGHIRNRRGDYSHTFSRKDLQAELDLLFEKQKEFGNPHISDDLKEGIETLLMTQRPALSGDAVQKMLGHCTFEPTEPKAAKNTYTAERFVWLTKLNNLRILEQGSERPLTDTERATLMDEPYRKSKLTYAQARKLLELDDTAFFKGLRYGKDNAEASTLMEMKAYHAISRALEKEGLKDKKSPLNLSPELQDEIGTAFSLFKTDEDITGRLKDRVQPEILEVLLKHISFDKFVQISLKALRRIVPLMEQGKRYDEACAEIYGDHDGKKNTEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENNRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 561 - protein, 1081 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 562 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGEEIRPCRLKKRPPVR

SEQ ID NO: 563 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 564 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLYQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 565 - protein, 1081 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAKLALNKFEKESGHIRNQRGDYSHTFSRKDLQAELNLLFEKQKEFGNPHISDGLKEGIETLLMTQRPALSGDAVQKMLGHCTFEPTEPKAAKNTYTAERFVWLTKLNNLRILEQGSEQPLTDTQRAKLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYNEACAEIYGDHYGKKNTEEKIYLPPIPADEIRNPVVLRALSQARKVINGVVRRYGSPARIHIETAREVGKSFKDRKEIEKRQEENRKDREKAAAKFQEYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 566 - protein, 1081 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLSLEDTAFFKGLRYGKDNAEASTLMEMKAYHTISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 567 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGGKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 568 - protein, 1081 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEEIYLPPITADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKENSREWQEFKARVETSRFPRSKKQRILLQKFDEDGFKERNLNDTRYVNRFLCQFVADRMRLTGKGKKRVFASNGQITNLLRGFWGLHKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKDLEKMVNRAREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 569 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADKIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 570 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 571 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTLWQLRAAALDRKLTPLEWSAVLLHLIKHRGYLSQRKNEGETADKELGALLKGVAGNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPTEPKAAKNTYTTERFIWLTKLNNLRILEQGSERPLTDTERATLMDEPYRKSKLTYAQARKLLELDDIAFFKGLRYGKDNAEASTLMEMKAYHAISRALEKEGLKDKKSPLNLSPELQDEIGTAFSLFKTDEDITGRLKDRIQPEILEALLKHINFDKFVQISLKALRRIVPLMEQGKRYDEACAEIYGDHYGKKNTEEKIDLPPIPADEIHNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLTEKLSSRPEAVHEYVTPLFVSRAPNRKMSGQGHMETVKSAKRLDEGISVLRVPLTQLKLKDLEKMVNREREPKLYEALKARLEAHKDDPAKAFAEPFYKYDKAGNRTQQVKAMRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 572 - protein, 1082 aa, Neisseria meningitidis
MAAFKPNPINYILGLDIGIASVGWAMVEIDEEENPIRLIDLSVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFVWLTKLNNLRILEQGSERPLTDTERATLMDEPYRKSKLTYAQARKLLGLEDTAFFKGLRYGKDNAEASTLMEMKAYHAISRALEKEGLKDKKSPLRLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 573 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 574 - protein, 67 aa, Neisseria meningitidis
MFGYFASCHRGTGNINIRIHDLDHKIGKNGILEGIGVKTALSFQKYQIDELGKEIRPCRLKKRPPVR

SEQ ID NO: 575 - protein, 220 aa, Neisseria mucosa
MRHIFSDGLKEGIETLLMTQRPALSGDAVQKMLGHCTFEPTEPKAAKNTYTAERFIWLTKLNNLRILEQGSERPLTNTERATLMDEPYRKSKLTYAQARKLLGLKDTAFFKGLRYGKDNAEASTLMEMKAYHAISRALEKEGLKDKKSPLNLSPELQDEIGTAFSLFKTDEDITGRLKTELTPASNKTLSRPFTVKSASNGSTSAPWLPSTKWFLHFKPA

SEQ ID NO: 576 - protein, 392 aa, Unknown
  Neisseria sp. oral taxon 020 str. F0370
MAPFTLKPLNYILGLDIGIASVGWAVVETDSDVLPYRLIDVGVRTFDRAEVPKTGESPAAARRLARSVRRMIRRRAHRMLRARRLLKREGMLQAADFDAHGLVENLPVNPWQLRVDALSRKLMPLEWAAVLLHMVKHRGYLSQRKNERNSSDKELGALLSGVAANSEALQGGDFRTPAELAVNKFEKESGHIRNQRGDYSHTFNRKDVQAELVLLFEKQKEYGNPYISDGLLTGVEDLLMTQRAALSGDAVQKMLGRCTFEPEEYKAAKNTYSAERFVWLTKLNNLRILDQGSERPLTDSERAKLMDEPYKKTKLTYAQVRRLLELDDTAFFKGLRYSKDNAESATLMEMKAYHSISGALEKAGLKNKKIAAGLIARIAGRNRRGVFAIQNR

SEQ ID NO: 577 - protein, 701 aa, Unknown
  Neisseria sp. oral taxon 20 str. F0370
MQDEIGEAFSLFKTDEDIRGRLKGKLPDEQLDALLEYVSFDKFVQLSLKALRKILPLMEQGKRYDEACAEIYGDHYGIKDDKQAQFLPPVSADEIRNPVVLRALSQARKVVNAVVRRYGSPARVHIETAREVGKSFLDRKKIEKRQEENRKDRERSIAKFREYFPNFVGEPKAKDILKMRLYEQQQGQCLYSGKAIDLRRLNEKGYVEIDHALPFSRTWDDSFNNKVLVLAGENQNKRNQTPFEWLGGDEKRWREFTARVEHCRFPRSKKQRILMQKLDEKDFKERNLNDTRYVNRFLCNFIAQNMLLTGEDKNRVFASNGQITNLLRGMWGLKKVRESNDRHHALDAVVVACSTVAMQQKITNYVRQKEMNVFDGEMVDKTTGEVSRLHFPQPWDFFRQEVMMRVFGKPDTPSENNEEADTPEKLRALLADKLSSRPEAVHEAVTPLFVSRAPSRKMSGQGHMETIKSAKRLSEGKSVLRVPLTQLTPKLLENMVNREREPQLYEDLLGRLNAHGGDPAKAFAAPFFKRDKAGNPTQQVKAVRVEDVQKSGVIVREGNGVADNATMVRVDVFEKGGKYYLMPIYTWQAAKGILPNKAVIAHTDEANWQEMDTSFTFKFALYPNDLVLASLKKETYFGYFAGLDRSTGNISLRVHDLEKSKGKDGVYRIGVKTALSFQKYQVDELGKTIRPCRLKKRPPVR

SEQ ID NO: 578 - protein, 1089 aa, Unknown
  Neisseria sp. oral taxon 014 str. F0314
MTAFKPNPLNYILGLDIGIASVGWAMVEIDDKENPVRLIDLGVRVFERAEMPKTGDSLAAARRLARSVRRLTRRRAHRLLRARRLLKHEGVLKPEDFDENGLVKPLPYIPKQPRNTPWQLRAAALDRKLTPLEWAAVLLHLVKHRGYLSQRKNEGETDDKELGALLKGVADNTHALQAGNFRTPAELALNKFEKESGHIRNQRGDYSHTFSRKDLQAELVLLFEKQKEFGNPYVSDDLKNGIENLLMTQRPALSGDAIQKMLGHCTFEPAEPKAAKNTYTAERFIWLTKLNNLRILNQGNERPLTDAERTTLMDEPYKKSKLTYAQARKLLDLDDTAFFKGLRYGKDNAESATLMEMKAYHAISRALEKEGLKDKKSPLSLSPELQDEIGTAFSLFKTDEEITGRLKGCLQPEILDALLKHISFDKFVQISLKALRRIVPLMEQGKRYDEACAEIYGDHHGRRNSEETLYLPPIPADEIRNPVVLRALSQARKVINGVGRRYGSPARIHIETAREVGKSFKDRKEIEKRQEENRKDREKAAAEFQEYFPNFVGEPKSKDILKLRLYRQQNCKCLYSGKEINLGRLNEKGYVEIDHALPFSRTWDDSFNNKVLVLGSENQNKGNRTPYEYLNGKDNSREWQEFKARVETSRFPHSKKQRILLQKFDEEGFKERNLNDTRYVNRFLCKFVADHMQLTGKGKRRVFASNGQITNLLRGFWGLRKVRAENDRHHALDAVVVACSTVAMQQRITRFVRYKEMNAFDGKTVDKETGEVLHQKTHFPQPWEFFAQEVMIRVFGKPDGKPELEEADTPEKLRALLAEKLSSRPEAVHEYVAPLFVSRAPNRKMSGQGHMETIKSPKRLDEGISVVRVPLTQLKLKDLEKMVNREREPKLYEALKARLEAHKDDPAKAFAEPFYKQDKAGNRTQQVKAVRIEQVQKTGVWVRNQNGIADNATMVRVDVFEKGGKYYLVPIYSWQVAKGILPDKAIIAFKDEEEWQLIDDSFNFKFPLHPNDLVEVITKKARIFGYFASCHRGTGNINIRIHDLDNKVGKNGILEGIGVKTALSFQKYQIDELGKEIRPCRLKKRPPVR

SEQ ID NO: 579 - protein, 1097 aa, Neisseria wadsworthii
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGHLRNKGGEYTHTFNRLDLQKELHLLFERQYALGNPFASAELQSKVDELLMTQRSALQGEAVLKMLGKCTFEPSEYKAAKNTYSAERFIWLTKLNNLRILYNGEERALDEGDRKKLLDEPYKKAKLTYKQVRSILNLPESAVFKGLRYGKDSDGLKAENGTLMEMKAYHKIRTILDKAGLKGEWENRIRNPEILDKIGTAFSLYKTDEDIQAALADLRLPENVLDALLAGLNFDKFIQLSLKALRNILPLMERGIRYDEACKEVYGDHRALAESKNQVLLPPIPADEIRNPVVLRTLTQARKVINAIIRRYGSPQRVHIETARELGKSKQERDKIDRKNKENQNDRNRLASDIRKHFNFEPTPKDILKLRLYEQQHGKCLYSDLREEKGECLYTGNVIELHRLFEDGYVEIDHALPLSRTWDNSLNNKVLVLKSSNQNKGNKTPYEWLDGANNSRRWREFQARVQGCHFPYVKKQRIQTAKLDSKAEQGFLERNLNDTRYISKFMCQFITANLRLAETSNALMEEVAGENPYWKERKRQRVFAPSGSIIALLRGLWGLKKVREDNDRHHALDAIVVACSTVSMQQKITKAMQRRETLETVDSETGEVKTRIPQPWDFFRQEVMIRVFSDSPREELAEKLNSRPEALHDFVSPLFVSRAPNRKMTGQGHLETVKSAKRLSENISVVRKPLTALKLKDIENIVGYPDREPALYQALRERLLAHKDDPVKAFADKPFYKPAKDGGQGSLVKAVRIIENTKHGLKIRNGITDTNGDMVRTDVYQKTDKKGKRQYFIVPVYAWQVEKNELPTVDCKGYEIDDNYEFCFSLYKYDLIEIQNPNDINQELRAYYINCDSSDGRFWLAYHDKSAKEQQFRISTQNQPIIKKYQVDTLGKEIRLCKAEKRTALNGKKKK

SEQ ID NO: 580 - protein, 1426 aa, Niabella soli
MPRKNILGLDLGTTSIGFAKIIEDDDYQCSSVELIGVRVNPLTTDEQTNFEKGKPVSVNADRTLKRGMRRNLDRYQLRRDYLIEILRTHHIITADTKLAEDGKNTTHTTYALRALAATAEIPLEAFVRVLLAINKKRGYKSSRKAKNEDEGQLIDGMAIARRLYEESLTPGQFSYQLLKEGKKYLPDFYRSDLNTELNKVWNFQKQFYPEILTDEFKRHLEGKGQRATAVAFWGQHGFSMAENKGSREEKKLHAYKWRSEAAHKQLTKEEVAFVITEINNDLNKSSGYLGAISDRSKELFFNKQTVGQYLHQQLKENPHTRLKGQVFYRQDYLDEFETIWEMQAKFYSALTLELKEEVRDVVIFYQRKLKSQMGLISLCEFESKEIEIEKNGEKAKKRIGLRVAPKSSPLFQEFKIWQVLNNLEFRNKKTKEVFVPEMAAKQQLFDELNIKGNLLASEAIKILGYKTKDWEANYHTLEGNRTNKSLYDAWLKILELEGYDENLLKLSGSDDIDVSKIEKPALEIRQMVLAVFEVLGISGAILDFDAEADGKAFEQQPAYQLWHLLYSAEDDGKKYSQEDIFTYGHDNIGLKKKLCEKFGFRPEHTKILVNVVFSDDYGNLSSKAMRRIYPFIKELTYDKACAEAGYRHSAASLTKEEIAARPLQNRLDLLKKNELRSPVVEKILNQMVNVVNTLVDDENQNRKARGLSEDFHFDEIRIELARELKKNAKERAEMTTNINTAKQSHEKIIRILQTEFGVPNPSRNDIVRYKLYEELKNNGYKDLYTNTYISRDILFSKQIDVDHIIPQMSLFDDSFSNKTVVFRKDNQDKGNKTAYDYILGKYGEQALEEYISRITSLFELGKKNKEEGIGKAKFQKLQKRLVDIGDGFIERDLRESQYIAKKANNMLYAICRSVVSTSGEITARLREDWDLVNVMQEINLPKFRALGLTEMVEKKDGAQKERITDWTKRNDHRHHAMDALAIAFTRHSHIQYLNHLNARKDEANKWHPVVSKIEEKETVLIYDDLGNRKRKFKAPMPNFREVVKEHLENVLISHKAKNKVVTKNKNKIKTVRGEKVKTELTPRGQLHKETIYGRYRYYESKEEKIGPKFDAEMIGMVTNPQYKKLLLERLAANGNDPKKAFWGKNALNKNPLYVDEARQELLPEKILLRWLNDDYSIRKDVTPENLKDIKTIEKILDKGVKKILLKRLADFGNDPKKAFSDLDKNPIWQNEAKRIAIKRVTISGIKNAAPLHHKKDHLGNDILDEKGKQIPSSFVSTGNNHHVAIYRDAEGNLQERVVSLFDAVQLVNGGEPVIDKEYNKGIGWQFLFTMKQNEMFVFPDEKTGFNPREVDLLSSGNRKLISPNLFRVQKLASKNYFFRHHLETSVEEKKELKNIAYKPQLGLNALSNIVKVRINHIGEIVSVGEY

SEQ ID NO: 581 - protein, 79 aa, Nitritalea halalkaliphila
MPLRLPERVYKMISSTGAECHFLPVNVSSLIKGYDAKSKLGEFGSQNKQEVTSDSFIRVKERCYKLEINRLGIPLNRLK

SEQ ID NO: 582 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 583 - protein, 1389 aa, Oenococcus kitaharae; identical to SEQ ID NO: 236

SEQ ID NO: 584 - protein, 1535 aa, Ornithobacterium rhinotracheale
MNTILGLDLGTNSIGWALIKVLNDKTRLPLEIIDLGVVVIPTDQRTLDKFSKGESISKTAERTKQKGVRKLYERKKLRRERLHRVLNILGFLPEHYSKKIDFKKHLGQFFGNSQPKISYVENDHGKHEFIFMDSYREMLKEFSKHNIKNVPYDWTIYYLRKKALSQKISKEELAWVILNFNKKRGYYQFRDDNADENKENKIEKYYALKVTNVKKEDAQNYTITLENGWIYKNKSKISLLDWVGSTKEFISTEKFDNKGNIIKKKNGEDDRTLKLVDSEKDWIAIKKSTEDRIENYGKTVGTYLYEHLLKDPNQKLNGELINIIDRKFYKNELKQILEKQKEFHPELLNEDLFQKSIIELYPKNSTRQKELKNKDLCYLLIDDVIYYQRDLKKKNSTINKCSFESREYYLNGEKQIQKINCIAKSKPLYQEFRTLQFIKNLKVYEIIDGLEKDITSKLLPDFETKEHFFEWLNDKEKIDQLQLLSYKCFDLHDNVKNDLIAKGIKRPTEKAIRTELLEKYRWNYSKDNDRNFLLNETRFKILKYLKKVDKKLTLTNEQIESLWLLLYSAKDERELKNGLQKFSEKNKLPKKFSDIFISFPPFKKEYGAYSEKALKKLLSLVRFGKYWSFNKIDNNIQNKIMNILNGEVDDSISDRVREKTILLQDKNDFQDLPLWLASYVAYNRFSEVSEIKYWDSPDKIEFLKQHSIGNPIVEKIINETLKLIKDIWVIHGKSCKNFFSEIHIELSREIKSSSKKRAQITNNNTKNQKLNNLIKSLLIEMASDTKYENVTPYSPSQQEILKIYDEGIYSKEENSEKIKEINKIRNNNKISKSDITKYKLWLEQGYISPYTGKIIPLTKLFTAKYQKEHIIPQTKFFDDSFNNKVICEAEVNKLKDNSLAMNFIKAKGGKAVKLSDGETVTILNQEEYKQLVRTSFKKNSIKLRNLLLEEIPDTFTKRQLNDTKYISKLVLSLLSNIVREKGELESTAKRIVSTNGQITSILRNDWGLNNIWNKLITPRFERLNNINKNKIYGNWENKKGKNVFQINYLNDNLSTLNTKRIDHRHHALDALIVACTTRNHINFLNNQYAKSRNQRHDLRAKLKRRETITTEGSKKQVFKDFIKPWESFTQDALKKLETTIVNFKVNKRIINKTINWYKKWEKQKDGTYKKIQKKQTKGDAWAIRKPLHIDTIYGIVCKKLPLKSALENYKNIIDENLKHKIKELKEVNKFDNNQIINFFKECNFIFEDNNIQKVEVYDFKDNRDKTILSSSRQLIDESFTPKKIGKVLDPTIRNILLKHLNSTKYNNKFDSDGNPIKPEKLAFSPEGLKDLNKNIKHLNNNKEHQPIKRVKLFETLGNKIKVGYTQQKNKKFAETATGTNLFLGIYSDNNKRDFKTIPLILAIQREKEGLNPCPDTDEKGNQLLFSLSPNELVFVPNNEERKNPNLVDFENLSKDQIDRIYKFVSCTGSEAYFVPSRTAKPIIENENGTNNKSQRIIEFNEKTSIKNEKNEPVLIKTICWKIEVNRLGKIIKVIK

SEQ ID NO: 585 - protein, 103 aa, Parabacteroides merdae
MIVYRLFYRFLFKATKLVNFVIHKELKRQIARTGKIKFHSGGCGCQSGNYKMQNFEKGKSITTNADRTLKRSMRRNLYRCKLRRDVLIELLKKVGFIPEKQWK

SEQ ID NO: 586 - protein, 82 aa, Parabacteroides merdae
MSIWKLQYPPLDLKIYNKFLVYSRVNPLTVDEMQNFEKGKSITTNADRTLKRSMRRNLQRYKLRRDVLIELLKKVGFMSEKQ

SEQ ID NO: 587 - protein, 84 aa, Parabacteroides merdae
MSIWKLQYPPLDLKIYNKFLVYSRVNPLTVDEMQNFEKGKSITTNADRTLKRSMRRNLYRCKLRRDVLIELLKKVGFIPEKQWK

SEQ ID NO: 588 - protein, 398 aa, Pasteurella bettyae
MLANENQNKGNLTPYEWLDGKNNSKRWQDFVARVQTCCFSHRKKQHILSHKLDEKSFIERNLNDTRYVARFLCNFIADNMLLTGKGKRKVFASNGQITALLRGRWGLQKVRDDNDRHHALDAVVIACSTVAMQQKITRFVKYEEGNVFSGERIDRETGEIIPLYFPTPWKFFKENVEIRIFSENPKLELENRLPDYPQYNHEFVQPLFVSRMPTRKMTGQGHMETIKSAKRLDEGISVLKVPLTQLKLADLENMVNRERELALYEALKERLELFGNDPAKAFIEPFYKKGGALVKAVRVKKVQKSGVLVRDGNGVADNALMVRVDVFTKGGKYFLVPIYTWQVAKGILPNKAVTANIDEIDWLEMDESYQFIFTMYPNDLVKVKLKKEEFFGYYGGLD

SEQ ID NO: 589 - protein, 610 aa, Pasteurella bettyae
MNMLKPLNYILGLDLGIGSVGWAVVEIDEQGNPLRLIDVGVRTFERAEVAKTGESLALARRLARSSRRLVKRRAARIKKAKRLLKAENILLSVDEILPNDVWQLRVKGLDHKLERQEWAAVLLHLLKRRGYLSQRKNESKSENKELGALLSGVVTNHQILQTDEYRTPAEIAVHKFQAEDGHIRNQRGDYTHTFSRLDLLAEMELLFQRQTELGNLHTSSKLLENLTALLMWQKPALAGEAILKMLGKCTFEPTEYKAAKNSYSAERFVWLTKLNNLRILEQGAERALTDSERFVLLDQPYEKAKLTYAQVRTLLKLSDEAIFKGVRYQGEDKKTVESKTTLMEMKAYHQIRKALDGADLKDEWNTLKNDSALLDEIGTAFSLYKTDDDISHYLGGKLSEKVLNVLLENLNFDKFIQLSLKALQKILPLMLQGQRYDEAVSAVYGDHYGKKSAESCRLLPAIPANEIHNPVVLRTLTQARKVINAVVRLYGSPARIHIETGRKVGKSYQDRKKLEKQQEENREQRESAVKKFKEYFPNFVGEPKGKDILKLRLYELQQSKCLYSGKSFDPNRLLEKGYVEVDHALPFSRTWDDSFNNKVCLPMKTRIKAI

SEQ ID NO: 590 - protein, 199 aa, Pasteurella multocida
MACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNA

SEQ ID NO: 591 - protein, 63 aa, Pasteurella multocida
MQTTNLSYILGLDLGIASVGWAVVEINENEDPIGLIDVGVRIFERAEVPKTGESLALSRRLAR

SEQ ID NO: 592 - protein, 1058 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKESAESATFMELKAWHAIRKALENQGLKDTWQDLAKKPDLLDEIGTAFSLYKTDEDIQQYLEGKLPDSVINALLVSLNFDKFIELSLKSLRKILPLMEQGKRYDQACHEIYGHHYGEKNQQISQLLPVIPTQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKVRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYVGLKARLAEFNQDPAKAFATPFYKQGGQQVKAIRVELVQKSGVLVRQGNGVADNAPGSIVRTDVFIKNNKFFLVPIYTWQVAKGILPNKAIVAHKNEDEWEEMDEGAKFKFSIFPNDLIELRTKTECFLGYYIGPDRHNGSISLREHDSEISKGNAGVYRVGVKLALSLEKYHIDELGKNRRICRPHQRRPVR

SEQ ID NO: 593 - protein, 1056 aa, Pasteurella multocida
MQTTNLSYILGLDLGIASVGWAVVEINENEDPIGLIDVGVRIFERAEVPKTGESLALSRRLARSTRRLIRRRARRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVFLNFDKFIELALKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKIRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 594 - protein, 134 aa, Pasteurella multocida
MVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKK

SEQ ID NO: 595 - protein, 53 aa, Pasteurella multocida
YSKENAESATFMELKAWHAIRKALENQGLKDTWQDLAKKPDLLDEIGTAFSLL

SEQ ID NO: 596 - protein, 1366 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEEDRKFDIREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQTRPEFAALIQQANEKQFEGNDPNNVWENIESILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGKYLYKCYPKLRPYFVYGKFKKFGDNEDIEVGDGRFNFLNRIERLKNVTDPETGEILWSNVAPNETIKQIKKVYNYKFMLVSRETTTRRAELFNQTVYPKNYRGKLIPIKEDRPTDLYGGYSGNTDAYLAIVALEDKKKGKYFKVVGIPTRAAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 597 - protein, 1229 aa, Pediococcus acidilactici; identical to SEQ ID NO: 125

SEQ ID NO: 598 - protein, 270 aa, Pediococcus lolii
LFNQTIYSAKASKTMIPIKNDRPTKLYGGYSGNEDAYMSIIRLSDKKKTYKVVGISMRDASKLKAYENNAHEEYLKKLKEVIEQQFLDSGKKTKADFEIVIPKVNYHQRMQDGTKQFRIGSSKYVHNTKQLVLSEKTLKAIRNNKQYNGDAEKDLINAFDEILTIVNDSFSIFDIRSFRKKLNESRDKFVSLPVEDTKEKSKVIKGKRETLKQILIALHANGTSQDIPQLGLKSFGKMVKTGGLTLSENTALIHQSPSGLFEHKIKLSDL

SEQ ID NO: 599 - protein, 1016 aa, Pediococcus lolii
MNGIFDAHLAEVDPTFLARLKESNRSNLDPKKSFQGSLLFPERKDYQFYKEYPTIYHLRKALMEKDRKFDIREIYLAVHHIIKYRGNFLNGTPMRSFKVENIELDTLFDRLNQLYEEIIPDNELAFDLEQVADVKEVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYKDHRHHLELLKKVIEDHSDAKKAKALKETYTAYVGKTDDKTQNKDDFYKAVEKNLDDSPEAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYEKFVVLNELNNLKINGRHLSLKDKQDIYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWHSTENFMQIQTRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDRLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIERDKKVVAPETGEILWSNVAPNETIKQIKKVYDYKFMLTSHETYTKHG

SEQ ID NO: 600 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 601 - protein, 211 aa, Porphyromonas catoniae
MGKKVLGLDLGVGSIGWCLITLDKDEKPQSILGMGSRIVPLSADDATEFTQGKAITKNKMRTVARTIRKGMDRYQLRREALKKVLREHAMLPDEALIKLPLLELWELRARAATPGEQVSLTELGRVLLHINQKRGYKHAKADEAAEAETKKGKETGYVAQVKGRYQILKEKGLTIGQHFAGELRANQQTAPRGTYYTYRIKEQVYPRVRGV

SEQ ID NO: 602 - protein, 1009 aa, Porphyromonas catoniae
MRIIREAYIEEYDRIMAVQRVFYPELLTDALIGRIRDRIIFYQRPLKSCKQLVSFCEFEKKEKVIRVKHTNKEGVQELVEKTITIGPKVAPKSSPIFQVCKVWESIHNIRLYHPDGTERKLEQEEKQKLFDYLQRNDKLSLTTLRKELKIKPKDKLWCDKLLEKGIAGNTTAAILRKAFKGYEHYERLFRFDLVRRDSHEADEDGVIRPIIDESYQNEPLYKLWHILYSIEDRAEMRSALIGQLGIKAEDLDNGLMDALYKIDFVKQGYGNKSAKFICKLLPHLQEGKMYSEAAEAAGMRHSDSMTAQERDERNLLEEIPLLQKNALRQPVVEKVLNQMINLVNALKREHGEIDEVRVELARELKMSREEREKATKNNSSREKENKAIAERITEYGLTPTKSRIQKYRLWQESAESCIYCGKRVDVVQFLRGEETEVEHIIPKSILFDDSLSNKACACRSCNQEKGNRFAMEYIQAKGWEQDYIERVDSLFHDKKISYSKRQHLLMLPKDLPEDFIERHLRLSQYISREAQGILRKGIRLVSASEGGVTAKLRQLWGYDNILRDLNLERYKSMGETEVVTVEHRDGQRTDERIKDWSKRKDHRHHAIDALVVACTRQSYIQRLNRVNAEADRQEMDAFIKEQQQEHKLSKKEKLSLLENWLKEQPHFTTGEVKEHAEGILISFRPGKRTVSRGRNIYKRSGKTDVQRNVLIPRGALSEETVYGVISVDGENKVVCKYPLQKFLDTKETNVDKIADQAAEKIVDKVLREKIRERIKRYGKKEAFAEPLYLDEAQTQVVRSVRCFISKDQAKLIPLRYNDESEAVGFVAPGNNHHLALYRDASGKMRASVVSFFAAVERARYGIPMIVLNPRETREKARIIPDLPESIFSKLPEEDWVLEETLQEGEMVLLGMENDAIEEAIKKKDYSKLSRYLYRVQSLSYNDYKFCFHLETESEKKEKKKGEDKKRGEKAKNTAVMPPKRYRIRCLATYQEDLNPRKVKIDLLGRISLA

SEQ ID NO: 603 - protein, 1197 aa, Unknown
  Porphyromonas sp. oral taxon 279 str. F0450
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 604 - protein, 1422 aa, Prevotella denticola
MTQKVLGLDLGTNSIGSSVRNLDLSDDLKGQLEFFSSDIFRSSVNKESNGREYSLAAQRSAHSRSRGLNEARRRKLWATLDLLIKYGFCPMSPESLMRWRTYDKQRGLFREYPIDDKNFNAWILLDFDGDGKPDYSSPYQLRRELVIRQFDFDQPIERYKLGRALYHIAQHRGFKSSKGETLSQQETNSKQSLTDDTADVAGEMKASEEKLSKGLSTYMKENNLLTVGAAFAQLEDEGVRVRNNNDYRAIRSQFQREIETIFKFQQGLSVENELYERLVSEKKNIGTIFYKRPLRSQRGNVGKCTLERTKPRCAIGHPLFEKFRAWTLINNIKVRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGERWKKLYHPSQIAIYRPVPANKDRSALRLGNPDIGAIKNPTVLRVLNTLRKRVNQLLDDGIISPDETRVVVETARELNDANRKWALDTYNRIRHDENEKIKKILAEFYPKRDNISTVDIDKARYVIDQREMDYFTEAKTYHKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQYAKDKEGKVLMKEGRPQINPTIKFVIRRELKYKKSSTDSGFASWDDLGKAIVDKELFALMKGQFPEGTSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 605 - protein, 443 aa, Prevotella disiens
MELDYWKGKYNRFTMTEIPEGFSRRQGMGIGLISRYAGLYLKTIFHKKDNPQKSNVYIVKGSITAEFRRIWNIQDDYEKKCRDNHIHHCIDAIVVGCIGKREYDLMAQFYRDEEKYRWEKKKKPFFKKPWETFTQDMLSLKDEVLTVHFNPSNFTKKAHKKVFTPKGIFVAQGDCARVKLHKESYFGAIEQKGEIKYVMRKELSALKIEDIKNIVDAVVKEKVLAVVKKKGFKQAMAEPIYMNEDKRILIKKVRLFVSQTNPLIVKKHRDLSSKEYKQNYYVDNEGNLMIAMYEGVKKNGKIDREITVVNNLEAAKFFRQSQKNNAEKQLISHLSPKNGYPLKTVLTQKQLVLMYEDSPKEIKLRDTKNMVKRLYQVVEIEKDGRVKLKFHQEARSEGLNKNSAAFKIQDTPESLYRHTKSNLKVLVNGVDFKINILGEISLI

SEQ ID NO: 606 - protein, 1375 aa, Prevotella histicola
MKKILGLDLGTTSIGWALVYESENTDEKSSIVRLGVRVNPLSVDEKGNFEKGKAITTNADRQQTHGARINLQRYKLRRENLKDCLQKQGWIGTEALCEEGKTSTFETYMLRAKAAEEEISLHELCRVLFMMNKKRGYKSNRKANNKEDGKLFDGMTVAKKLYEEHLTPAEYSFQLLSSGKKFKQEYYRSDLKEEFDRIWNEQQKYYPEILTDDFKQQLQGKSKGNTSKIFLGKYGIYSADLKGLDRKLQPLKWRVEALKQQVDKEVLAFVISDLNGQIASTSGLLGAISDRSKELYFNKQTVGQYLWTSLKETPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSIHPLYEEEKNLLYEELSVKEKLSKAEALKVLNKNSKQWDLNYKEIEGNRTQAVLYDCYNRIIVMTGHEEYNFKKLKASEIRSYVKTTFTGLGFNTDILEFDSSLTGHELEKQPMYQLWHLLYSYESDNSRTGNDALLRKLETAFGFPKEYAAVLSDVVFEDSYGNLSVKAMRKILPHLQAGLNYSQACEEAGYKHSRRSLTKNELDQKEYKEKLELLPKNSLHNPVVEKILNQMINVINAVIDEYGKPDEIRIELARELKIGAAERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRDTQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMVKVGAALDEVTIKKVSSSFIREALLDRLHEYNGDAKKAFTGRNSIDKNPIYIDEEHKKTVPALVKTIEWEMYHPTRKLISPDLKIDKVIDKGIREILKTRLAKFNGDAQKAFSNLDENPIYKDEAKKITLKRVSLEGVSSVIPLHTLKDREGKLVVGKDGKPVLGDYVQTSNNHHIAFYMDENGNLQDNVVSFFEAAERKSQGVPVIDKNYNHDKGWNFLFTMKQNEYFVFPNEVTGFNPSEVDLMDEANYSIISPNLYRVQKMSKASGRDYWFRHHLEAMLNDDPKLRNSMFKRITSLKALEGIVKVRINCIGKIVAVGEYD

SEQ ID NO: 607 - protein, 1380 aa, Prevotella intermedia
MKRILGLDLGTTSIGWALVNEAENNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKFQPLKWRVEALQQQVDKEVLAFVISDLKGQIANTSGLLGAISDRSKELYFNKQTVGQYLWASLEENPHISIKNKPFYRQDYLDEFEKIWETQAAFHKQLTPELKQEIRDIIIFYQRPLKSKKSLISVCELEQRKVKATIDGKEKEITIGPKVAPKSSPVFQEFRIWQNLNNVLLIDNDTNEKRPLDEVERNLLYKELSIKAKLSKTEALKILNKKGKQWDLNYRELEGNRTQAILFDCYNRIITLTGHEECDFKKIKASEIRHYVSTIFKNLGFSTEILDFDPSLKKHELEKQPMYQLWHLLYSYESDNSRTGNESLLRKLETTFGFPEEYATVLCDVVFEEDYGNLSVKAMREILPYLQAGNDYSQACAYAGYNHSRHSLTKEELDQKVYKERLELLPKNSLRNPVVEKILNQMINVINAIIDEYGKPDEIRIEMARELKSSAADRKKTTHAISQGNAENQRIREILEKEFSLSYISRNDIIKYKLYEELEPNYYKTLYSDTYITKDKLFSKDFDIEHIIPKARLFDDSFSNKTLEARNINLEKSNKTAFDFIKEKYGEDGAEAYKKKLDMLLENDAISRPKYNNLLRAEADIPSDFINRDLRNTQYIAKKACEILGELVKTVTPTTGKITNRLREDWQLVDVMKELNFEKYEKLGLTEIVEDRDGRKIKRIKDWTKRNDHRHHAMDALAIAFTKPSFIQYLNNLNARSNKGDSIYAIENKELHYEEGKLRFNAPIPVNEFRAEAKRHLSAILVSIKAKNKVMTQNVNKIKTKHGIIKKIQLTPRGPLHNETIYGTKMRPIIKMVKVGAALDEATINKVSSPAIREALLKRLNEYSGNAKKAFTGKNTLEKNPIYLNAGRTKTVPSLVKTVEWESFHPTRKLIDKDLNVDKVVDKGIREILKARLEEFNGDAKKAFSNLEENPIYLDEAKKIALKRVSIEGVLSAIPLHTLKNQAGKPITGKDGKPVLGNYVQTSNNHHIAFYYDEDGNLQDNAVSFFEAAERKSQGIPVIDKDYNRDKGWRFLFTMKQNEYFVFPNEATGFIPSEVDLTDEANYGIISPNLYRVQKVSRIDKGTSASRDYWFRHHLETILNDDAKLKNLAFKRIRGLLELKDIIKVRINSTGKIVAVGEYD

SEQ ID NO: 608 - protein, 129 aa, Prevotella multiformis
MQKGGTGCKINRQTVGNVEVNVLNLRLYDRTDDREVTAGYLPTKEDYVRLFVYLNDRKEINQDTLLKDYFRLKKVKCGNEKEFAIRWNYIEDKEKKYPCNETRHELLAALDRAGMEHGWLDDSGTSARW

SEQ ID NO: 609 - protein, 535 aa, Prevotella multiformis
MVKGLLSNIVRTAEEREETSKFVISCTGRITDRLKQDWGLNDVWNSLVYTRFKRLNELTETEAFGHWQDKDRRVFQTSVPLELQRGFSKKRIDHRHHAMDALVIACASRNIIGYLNNESAESPEKREDLRRKLCDKNHIIRKPWESFTQDARAALEDIVVSFKNYVRIINKATNYYERYDADGRKTKAEQKGGEMWAVRKPMHEATYYGKVNLRRKERVSLKAALEDIPSICNRDLRDYINGLVEKHFNKEQVLAQFRSVGNRWNKQHIDKVDVWRFSDGKEEMVATRKPLDTSFDAKRIEAVTDTGIQRILSNYLEAKGGDPKIAFTPEGIADMNQHITAYNNGKQHKPILKVRVSTKLGKKYPVGQTGCKAGQFVVAEAGTNLYFAVYEDGEGNRSYDTIPLNEAVECLKQGLPPVPETREKGDRLKFYLSPNDLVYVPAGDEENEIDRERIYKFVDSSGTTANFIPHRTAGLIYNVDKKLAEALCNGSIIQNEYGVGSQQSKNQKALTGEMVKAVCWKLEVDRLGNILRIIK

SEQ ID NO: 610 - protein, 1380 aa, Prevotella nigrescens
MKRILGLDLGTTSIGWALVNEAESNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKLQPLKWRVEALKQQVDKEVLAFVISDLKGQIANTSGLLGAISDRSKELYFNKQTVGQYLWASLEENPHISIKNKPFYRQDYLDEFEKIWETQATFHKQLTPELKQEIRDIIIFYQRPLKSKKSLISVCELEQRKVKATIDGKEKEITIGPKVAPKSSPVFQEFRIWQNLNNVLLIDNDTNEKRPLDEDERYLLYKELSIKAKLSKTEALKILNKKGKQWDLNYKELEGNRTQAILFDCYNRIITLTGHEECDFKKIKASEIRHYVSTIFKNLGFSTEILDFDPSLEKHELEKQPMYQLWHLLYSYESDNSRTGNESLLRKLETTFGFPEEYATVLCDVVFEEDYGNLSVKAMRKILPYLQAGNDYSQACAYAGYNHSRHSLTKEELDQKVYKERLELLPKNSLRNPVVEKILNQMINVINAIIDEYGKPDEIRIEMARELKSSAADRKKTTHAINQGNDENQCIREILEKEFALSYISRNDIIKYKLYEELKPNGFKTLYSDTYIPKDKLFSKDFDIEHIIPKARLFDDSYSNKTLEARDINLAKSNKTAFDFVKEKYGEQGAEAYKKKLDMLLGNNVISKPKYNKLLMTEADIPSDFINRDLRNTQYIARKACEILGELVRTVTPTTGKITNRLREDWQLVDVMKELNFEKYEKLGLTEIVEDRDGRKIKRIKDWTKRNDHRHHAMDALAIAFTKPSYIQYLNNLNARSNKGDSIYAIENKELHYEEGKLRFNAPIPVNVFRAEAKRHLSAILVSIKAKNKVMTQNVNKIKTKHGIIKKIQLTPRGPLHNETIYGTKMRPIIKKVKVGAALDEATINKVSSPAIREVLLKRLNEYSGNAKKAFTGKNTLDKNPIYLNAERTKTVPASVKTVEWENYHPIRKPITPDLKVDKVIDKGIGEILKARLEEFNGDAKKAFSNLEENPIYLDQTKKIALKRVSIEGVLSTIPLHTLKNQAGKPIMGKDGKPVLGNYVQTSNNHHIAFYYDEDGNLQDNAVSFFEAAERKSQGISVIDKDYNRDKGWRFLFTMKQNEYFVFPNEATGFIPSEVDLTDEANYGIISPNLYRVQKMSRIEKGTSVSRDYWFRHHLETILNDDSRLKNSAFKRINSLKPLEGIIKVRINSIGKIVAVGEYD

SEQ ID NO: 611 - protein, 1506 aa, Prevotella nigrescens
MKTILGLDLGPNSIGWAKVEVDDEGNYLRNIKLGSRIIPMTQDMLGDFDKGVKVSQTAIRTDFRGNRRLIERHLLRRERLHRVLHALKFLPKHYEDAIGWDRNEPATYGKFVNNSEPKLAWERQEDGSMRFLFMESFNEMVADFAQNQPSLVSDGKKIPLDWTIYYLRKKALTRPIKKEELAWILLNFNQKRGYYQLRGEEEEDNLTKRKEYYKLKVVGVEADGAPKGGKTWYNIHLENGWTARCQSKIPLDDWVGKVKEYIVTTEYEDDGKTPKCDKEGKVKRSFKSPEKDDWQLIKTRTEKFIDDSNKTVGAFIYDYLLEKPFDKIRGKYIRTIERKYYKNELREILREQTKYHEGLHSLEALKICAEELYKNNQQHQEYLLKKDMTFLLLNDLIFYQRPLKSKKSLIADCPYEVYKYDDKLTGKKGQKKIKCIAKSNPYYQEFRLWQFIANLRLFSVTDGKEVTAEYLKTEEDYVRLFSFLNDRKDIKQETFLRSFLKLKKESIGSEKIYPIRWNYIEDANKSYPCNATRHELLLAFDRADIPRELLDVEEREYRLWHLLYSIEAKEETESALRKLKANKAFGDLNIDDAFVNSFLKIKPFEKEYGAYSEKAIKKLLAVMRRGSLWKEADICEATKQNIAKILQNDIDEKLKKKIEAAVSSFNKLSDFQGLPTWLACYVVYGRHSEAAQIQCWQSPEDLKTYINKFKQHSLRNPIVEQCLLETLRTVYDIWKDAGQIDEIHIELGRNMKSTAEQRARKTKDILRNENTNLRIKNLLVELKNDDKIENVRPYSPSQQEILRIYEEGALQELSKEDEMFEDISKISKMAQPSPTELSRYKLWLEQKYRSPYTGRVIPLSKLFTTAYQIEHIIPQSRYFDDSFNNKVICESEVNSLKDNMLGYEFIKECGGRIVHCTLLGDVKIFTKEEYKDFVTKHYIDNTYKRDKLLLEDIPQEFSARQLNDSRYISKMVQTVLSNIVRAENEQEATSKFVVSCNGAITNRLKKDWGLNDVWSSIVCPRFKRLNEITKTNAFGHWEDKAGKHVFQTTVPLELQRGFSKKRIDHRHHAMDALVIACASRNIVNYLNNESANSPEKREDLRKKLCDEKRKIRKPWKTFTQDAREALSDVVVSFKNYVRVINKATNYYEHYSSSGNKVMISQKGNDMWAIRKPLHKESVFGRVNLCRKVIVSLKKALENIPAICDKTLRDYINALVEKHFNTRQLLAHFKSINYRLNRQCVEKVEVWQFSDEKIEMVARRKSLDTSFDDKQISSITDTGIQKILLNYLQTKDGNAEIAFTPEGIEEMNKNISLYNDGKAHQPILKVRVATPKGMKYPVGQTGNKATKFVVAEKGTNLYFAIYENELGVRSYDTIPLNIVVERLKEGLSPVPQANEADIPLKFYLSPNDLVYVPTKENEDELCRDRIYKFVDSSGTTANFVPHTSANTIYNVDKEYAEKCCNGAVFLNEYGLGSPQSKNQRALTGEMIKEICWKLKVDRLGNIIKVIK

SEQ ID NO: 612 - protein, 774 aa, Prevotella oulorum
MEQCILETLRTVYDIWKEAGQIDEIHVELGREMKQTAEQRAHLTEKVLRNENTNLRIKSLLMELKNDADMKDVRPYSPMQQEILRIYEEGALQTLSKDDAAFTEIMKISKMAQPSASELQRYRLWLEQKYRSPYTGKPISLSKLFTSAYQIEHIIPKKRYFDDSFSNKVICEAEVNGKKDSMLAYEFIKDCGGDVIHCTTLGDVTILSEAEYKALVTELYANNKSKKDKLLMEDIPQDFINRQLNDSRYISRVVMTLLSNIVRIEGEEEATSKFVIPCSGGITDKLKKDWGLNDVWNNIVYPRFERLNALTNTSDFGQWENKEGKRVFQTSVPLELQRGYQKKRIDHRHHAMDALVIACASRKIINYLNNQEANDPTKQENARKQLCIKSRIIRKPWETFTQDAYKALDNIVVSFKNYVRVINKATNYYERYNADGKKAVDEQKGEAMWAIRKPMHKDTVFGHVNLRRKAVVKLKDALENIPAICDKTLRHYIQDLQKKHFNTKQLLAHFKSINYRLNKQAVDKVEVWQYSDDKEQLAATRKPLGPSFDAKCIAAITDTGIQKILLNYLQAKGGDPAIAFTPEGIAEMNQNIAVYNGGKQHQPILKVRIAKPMGKKFPIGQTGNKAFQYVIAEEGTNLYFAIYEDEEGNRTYDTIALREVVERLKQGLTPVPEKNEKGVALKFHLSPNDLVYVPTADELLSKVCSLDKNRIYKMVSATKSECLFIPHSVAKTIYDKVEFEALNKMGRALTGEMIKSVCWKIEVDRLGHIVNIIK

SEQ ID NO: 613 - protein, 691 aa, Prevotella oulorum
MKTILGLDLGTNSIGWAKVIVDDNENYLRDIQLGSRIIPMSQDVLGKFDKGVTESQTAIRTSFRGVRRLRERTLQRRERLHRVLHTLHYLPPHYDSAIGWDRKTPTTYGKFLNHGEPKLAWERREDGTMQFLFMDAFHEMIADFAKYQPALVADGKKVPLDWTIYYLRKKALTQPIKKEELAWILLNFNQKRGYYQLRGEEDEENAAKHEEYHELKVVGVEVDEAGKGDNTWYNVKLENGWTYHRQSKIPLDDWVGKVRAFIVTTEYEKDGTTPKKDKEGNVKRSFRSPDEKDWGLRKKQTEHSLEASGTPVGAFIYDHLLKEPSDKIRGKFIHTIERKYYKQELAAILREQSKHHEKLCSKDMLKACIEELYPNNPLHRESLLKKDMPYLLIEDLIFYQRPLKSKKSLIAECPYEAYSYVDKETGEMKRQGIKCIAKSNPYYQEFRLWQLIANLRLRNRSDERDVTAEYLPHQEDYVRLFTYLNDRKEINQETLLKDFFKLKKVTIGGEKVFPIRWDYIEDKEKKYPCNATRHELLLALDRAGIEHDWLNDRDLAYRLWHLLYSVDSKDETERALRKLKDDDAFVESFLKIKPFEKEYGAYSEKAIKKLLPVMRRGSLWNEADLCPSTKERIANILQGTIDEKLKKKIGAFISSCQQVSDFQGLPEWLACYVVYGRHSEATDIQRWETPE

SEQ ID NO: 614 - protein, 242 aa, Prevotella saccharolytica
MKLVLGLDLGVGSVGWALIFITDSGEPIKILALGERIVSMDSNNSNEFSAGATCTLNQKKTKAKSVRKGYSRYVQRRDALTAELRHIGMMPDETLIKLPVLDLWQLRANAATEGKKLSLAEIGRVLYHINQRRGYKHGKSDVSSDNKQKGYVKAVNERYCMIQERQQTIGQYFALKLKETAVTTEKGTFYTFRIKDQVFPREAYEEEFVVAYSTKVLKFKQITTLLNVVICLMMLLLIVQRY

SEQ ID NO: 615 - protein, 1174 aa, Unknown
  Prevotella sp. oral taxon 317 str. F0108
MEFHPELCDAELLKACAEELYRNNEAHRAQLLAKDFKHLLVEDVLFYQRPLKSKKSLIANCPYETRQYINKETGEIKDVNVKCIAKSNPYFQEFRLWQWISNLRLLRQADGQDVTAAYIKGNEDKERLFDLLNNQGEIKQEHILRDFLKLKKPKGGEFPLRWNYVDDKIYPANETRHAINKAIKGMAVDKEEKETLGQLLDQPAVAYMLWNLLYSITDRNELARALRRFALTHGVSSVDAFVESFLKVKPFKKEYGAYSEKATKKLLQVMRLGKYWCGDELPEPAKRTKGNKQAVYDEMAHRGICKQTLQNISNIIEENIDERLMGALLNPERPLTELSHFQGLSVSDACYVVYGRHSEVAEIVKWKDADELNTFINNFKQHSMRNPIVEQCVLETLRTVRDVWEQEGQIDEIHVELGRNMKRTAEQRARDTQAIQRNENTNMRISLLLTELKNDPSISDVRPYSPSQRELLKIYEEGALENLTNQDEDIAKISRLAQPSASELRRYKLWLDQKYVSPYTGRPIPLAKLFTPAYEIEHIIPQSRYFDNSFSNKVICEAEVNKLKDNLLGMEFIKKFGGKTKGILDEEAYKLHVTTNYAHNPAKRSKLLMEDLPTDFNSRQLNDTRYISKTVMALLSNVVREEGERETRSKHVVVCTGGVTDTLKKDWGLHDVWHNLVYPRFIRLNNLTGSQNFGYWRYLNEENSKKGEDSKKVFQITLPPECQRGFVKKRIDHRHHAMDALVIACASANIVNYLNNQSAANPHIHENLQRLLCDRKREIRKPWPTFTQDAQAALKDLVVSFKNTVRVVNKASNTYLRYDKDGKKKRFKQEGEGLKAIRKPMHKETYYGEVNLIRKEMVPLKRALDDVNAIVDKELRASIKGLLRDGFNPQQVLANFKAKDFKFDKRDIKKVEVYVSSEKSTPMVATRKSLDTSFNAKRIADITDTGIQKILLNYLKANDNSPEQAFTPEGIAYLNEHIAEYNDGKPHQPILKVRVSEVKGAKFAVGQTGSKKDKFVEAQSGTNLYFAIYEDKEGKRHFETIALKVAAERLKDKQMPVPEINDAGLPLKFYLSPNDLVYVPTDEDRATAHPSIDKMRIYKMVSATDRQCFFLPFTVASVISNKVEFEALNKMERVLDASEYSSAYDSSHVNKVMVKNVCWKLEVDRLGNITKIVR

SEQ ID NO: 616 - protein, 992 aa, Unknown
  Prevotella sp. oral taxon 472 str. F0295
MITRILGLDTGTNSLAWAVVDRDANGNYTLVKRGDVIFTEGVKIEKGIESSKAAERTAHKALRVHYSRRRLHKIDTLKVLVELNLCPCLSDEQLSQWKAKKTYPLTDDFMLWQRSGSAEENNPYYCRHRCLTQKLDLTDQSQRFLLGRAFYHLAQRRGFLSNRLDTSADSDESGKVKSGIAQLSVEMEKAGCEFLGEYFYQLYKQHGNTIKLRSRYTDREEHYKKEFLAICEKQELDPKWVEALQRAIYFQRPLKSQRKGVGKCTFEPKKPRCAESHPDYEAFRMLCFLNNVKIQTPNDTSLRPLNEDEREKIWPIFFRKSKPNFDFEDIAKALAGKNNYAWYKDAGEKPFKFNYRMQQGVSGCPVTAQLIDIFGSDWQTAIAETYTAVEKKNGTKTIDEMADDVWNVLYSFSSKDKLKAFATEKLQLDEASATKFANAKLPHGFASLSLKAIRNILPFLRQGFIYAHAVHLAKIPDIVTKAVWNDADKREMILSGLMEIIENYNPKDRGVEGTIDFCIKSHLQDVIDLRPGAADALYHPSMIETYPDAKLNKMGVFQLGSPRTNAIRNPMAMRSLHILRSVVNQLLRDGIIDRDTEVHVEYARELNDANKRKAIADYQREQEKKRKQYRDDIIALYKSECHKEIEPTDTDILKFQLWEEQNHLCLYTGTQIGICDFLGDNPKFDIEHTVPRSVGGDSTQMNLTLCDATFNRQVKGAQLPSQLSNHADILVRIDHWKSKCEDLRKQLDKIRTYGGMEKNMKDRLIQKRHRLKMDLDYWQGKYSRFTMTEVPEGFSRRQGAGIGLVSKYAGLFLKSLFHNEQNPNKSNVYVVKGVTTAEFRRMWGLQGEYEKKSRLNHCHHCIDAITIACIGKAEYDKMAQYYHDEELFQWRGTTTKPHFNKPWPTFTEDVLAIEQSLLVKHLTKDNMPKQAKKRVRTATGKYLAQGDTARGSLHKDTYYGAIEQNGEIRYVLRKPLNKFENEAELEKIVDQA

SEQ ID NO: 617 - protein, 1375 aa, Unknown
  Prevotella sp. oral taxon 306 str. F0472
MKKILGLDLGTTSIGWALVNESENKDEQSSIVRLGVRVIPLTVDEKGNFEKGKAITTNADRQQVHAARINLQRYKLRRENLRDCLQKQGWIGSEPMCEDGKSSTFETYKLRAKAAVEEVSLHEFARVLFMLNKKRGYKSNRKANDKEEGKLFDGMTIAKKLYEEHLTPAEYSLQLLNTGRKFTPEYYRSDLIEEFEKIWNEQQKYYPEILTDEFKQQLEGKAKSNTSKLFLGKYGIYSADTKGLDRRLQPLKWRVEAMKQQVDKDVLAFVISDLKGQIANTSGLLGAISDRSKELYFSKQTIGQYLWASLQENPHISIKNQPFYRQDYLDEFEKIWETQATYHKELTSELKQEIRDIIIFYQRPLKSKKNLIAVCELEQRKVKVTVDGKEKEITIGPKIAPKSSPMFQEFRIWQNLNNILLLDHETNSKRPLYEEERNLLYEELSVKEKLSKTEALKVLGKKSKQWDLNYKELEGNRTQAVLYDCYNRIIVMSGHEECNFKKLKASDIRHYVKMIFKNLAFNTDILCFDSSLKGHELERQPMCQLWHLLYSYEGDNSRTGNDALLRKLETSFGFPKEYAAVLADVIFEDSYGNLSVKAMRNILPHLQAGKDYSQACEEAGYKHSRRSLTKEELNQKVYKEKLELLPKNSLHNPVVEKILNQMVNVINAVIEEYGKPDEIRIELARDLKIGAAERENMTRSINQGNAENKRIREILEKEFALSYLSRNDIIKYKLYEELKSNGFKTLYSDTYISKDKLFSKDFDIEHIIPKARLFDDSLSNKTIEARDVNIAKSNKTAFDFILERYGEQGVKTYKTKLLRLLEDGAISNKKYNNLLKTEADIPSGFIDRDLRNTQYIAKKAYEILSELVKIVTPTTGSVTNRLREDWQLVDVMKELNFEKYQKLGLADVIEDRDGRKVKRIKDWTKRNDHRHHAMDALTIAFTKPSYIQYLNNLNARSDKSSSIYGIEVKELHREEGKFRFNAPLPINEFRAEAKRHLKSVLVSIKAKKKVMTQNVNKIKTKHGIIKKVQLTPRGELHNATYYGTKKRPLVRMVKVGAALDEATIKRVCSPAIRAALLKRLNAYNGDAKEAFTGRNSIDKNPIYLDIEQTKLVPVLVKTIEWGMYHPIRKRITPDLKIDKVIDKGIREKLKARLAEFNGDAQKAFSNLDENPIYMDEAKRITLKRVSIEGVLSAIPLHTLKDKAGKPVIGSDGKPVFGDYVQTSNNHHIAFYIDDKGNLQDNPVSFFEAAERKSQGVPVIDRRYNCDKGWHFVFTMKQNEYFVFPNEATGFIPSEVDLLDEANYCIISPNLYRVQKLSKASGRDYWFRHHLETMLNDDLRLKNSTFKRIQSLKGLEDIVKVRINSIGKIVAVGKYD

SEQ ID NO: 618 - protein, 1483 aa, Unknown
  Prevotella sp. MSX73
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGTTLKTDKEGNVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQRWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIVEMNQNISKYNDGKPHQPILKVRITEPMGAKYRVGQTENKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGSECHFIPYYVANVIYNKVEFEAKNKIGRALTGEMIKAVCWKLEIDRLGNILKVIK

SEQ ID NO: 619 - protein, 593 aa, Unknown
  Prevotella sp. oral taxon 317 str. F0108
MNTRILGLDTGTNSLAWAVVDRDAKGNYTLVRRGDVIFTEGVNVDGQPVPSKAAVKSKYKSLRVQYARRRLRKIDTLKVLVSLDLCPYLSDQQLSQWKAKKTYPLTDDFMLWQRSGSAEENNPYYCRYRCLTQKLDLTDQSQRFLLGRAFYHLAQRRGFLSNRLDTTSDSAESGKVKSGIAQLSVEMEKAGCTFLGEYFYQLYKQHGNTVRLRSRYTDREEHYIKEFLAICEKQELDAQWVEKLQRALYFQRPLKSQRKGVGKCTFEPKKPRCAESHPDYEAFRMLCILNNIKIKTPKDVSLRPLNAEEREKVWPLFFRKSKPNFDFEDIAKALAGKNNYAWYKDAGEKPFRFNYRMHQGVSGCPVTAQLIDIFGSDWKAGIAETYTAVGKKNGTKTIDEMADDVWNVLYSFSSKDKLKAFATDKLQLDEARATKFANAKLPHGFAALSLKAIRNILPFLRQGFIYAHAVLLAKIPDIVTAAVWDDADKREQILSGLLEVIENYNPDDRGIEGTIDFCIKSHLQDVVDLRPGAADALYHPSMIEAYPDAKLNKMGVFQLGSPRTNAIRNPMAMRSLHILRSVVNLLLRDGMLS

SEQ ID NO: 620 - protein, 1424 aa, Unknown
  Prevotella sp. C561
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 621 - protein, 241 aa, Unknown
  Prevotella sp. oral taxon 472 str. F0295
QAVKEKIKEAIAGKNFKTAIAEPIFMNKEKGIRINKVRYYVKAQERLKIRQQRDLSSKEYKQFFCVENESNYLLAIYEGELKGKKERDFCVVNNLDSAACLKRSNKGKAAPLVPERSEERNLPLLAVLKRGTQVLFYENSPEEILFDNPQDLVRRLYKVTGINTKKDVKNGKTYLYGNIELRFHQNAQKKDDVKMQSGVYKNNEVLRQGIVLSHKQFKALVEGVDFEFNVLGEIKKKERHA

SEQ ID NO: 622 - protein, 1216 aa, Prevotella stercorea
MTKILGIDTGTNSLGWAIVDKTADNYNLLDKGVNIFQEGVKIEKGIESSKAAERTEHRATRVRYYRIKLRKIRLLRILSDNHLCPPLSQEELSTWRLKKVYPKNELFMQWQRTDDDTEKTPYAYRHKCIHEKLDLSDVTDRYILGRAFYHIIQRRGFLSNRKEQGGEDSGKVKEGISTLTHEMNEAGYEYLGDYFYALYNKGEKIRKHYTARNEHFLSEFKAICEKQDLEKELGSEVVRNIEKAIFDQRPLKSQKGQVGKCVFEKNKTKCPSSHPMYEEFRMLTFINNIKIKTPNDDVLRPLNTGEREKIMPLFFRKSKKQFDFEDITKKLAPKKMYGFYKKEEDAEMPFLFNYPMDTSVSGCPVTAALKDVFGDDWITAICETYTLGEGKSRFDIVNDIWHALYFYSDKDKLAEFAINRLQLSEDEAKIFSEISLPADYASLSLKAICKILPYLRRGLIYSHAVFLGNLCEVMPKYEWSIKEMRETIIDNIIMEMDKCDTKDKRTFEVCIKDYLKGQYNVSDNSLKKLYHPSMIETYPRVQYTNEHGVYQLGSPRIDSVRNPMAMRSMFRLRKLVNRLLVEGKIDQNTEVHIEFARELNDANKRNAIALFVKENQSANDEARKQIITLFKKETGTDIEPTDKDILKYVLWEEQNHICLYTGKQIRISDFIGANPKFDIEHTIPRSVGGDSTKMNLTLCDSRFNREVKKTKLPVELPNHDEIMERIKEWKKNYELLDIQIRKNKKLSKGATTKEQKDTIIRKRHLLELRRDYWRGKYERFTMESVPEGFSRRQGTDISVISKYARLYLKSLFNRVYTVKGIATSDFRKIWGIQDIYSKKERINHVHHCIDAIVIACIGLDEYNKLGAYYHDEENNKWYGMSKASFKKPWATFVEDIKKIQDEILVYHYTPDNMPKQGRRRIKIDGKKILCKGDAARGSLHNDTYYGAIENDGAVKYVKRIDLASLEEKDVKNIVDDTVRSIIEAAIKEKGFKDAMASTIWMNEEKRVPIKKVRCFTPSITKPLNIRKQRDVSIKEYKQQYHVANDSNYLLALYIGTDNKGKEKREFEIVNILQAAQYYRTSNDKEVVDRHIVPIKSEHDYPFAYTLKIGTMVLLYEKSPNEVWDATIKERNRRLYKVTGLSTMRMKGRNGEYAYATVKLIHNEEARPSKDIKAKNGEYEQGEEFRPAIIMLHTQLNALVQGYDFEINELGEIRRLR

SEQ ID NO: 623 - protein, 1487 aa, Prevotella timonensis; identical to SEQ ID NO: 130

SEQ ID NO: 624 - protein, 770 aa, Pseudoramibacter alactolyticus
MAKGYFASDEEIDFSGVDDGFKNTLSSHQKFKEIFDVEVLNDWQKSMSEKIIFWATVYGDSKKFLKERLEDAYGNELDQKQIKRILGLRFKDWGRLSEAFLNLEGKNSKTNQSQTIIEALWNGDGTNNFNLMELLSSQFTYRDTLKKRALKGEKTLTNITYEDLSDLYLSPSVRRMVWQTILIVKELRQVLGAGPAKIFIEMARDVTLKAGTRTTSRRQQLLDLYKNVQTESRNWVEEIETQEESRFRSKKIFLYYTQMGQCMYTGEPIVFKDLFNRNLYDIDHIYPRHFVKDDSLINNLVLVKKQANSHKSDTFPIENSIQQARRDFWKWLSEKGLISREKFNRLTRRTSFSDEELAGFISRQIVETRQGTKAVAQIFENALPDSEVVYVKAGNVSDFRHHFNLLKCREINDLHHAQDAYLNVVVGNVYHTKFTKNPINFIKGYRKDRKAYAYHMDQIFDHPVKRNDIIAWQTDKNQSIATVKKVMAKGTPLVTRMSYEEHGELSNQNICSAKAAQKAEGKGYLPIKNSERLSNTQRYGGYNKYAGSYFFLVEHTLKKNRVRTIETMPLFLRDTIKTSKDLLKYCCESLKLEAPSIRVMKIKMGSLLSVNGAFVYLTGRSGKKLITPNGFQLILPQKWQDYIRLLIKTKDSPDDVEGISGGKNIEFYDILVEKHTKTCLKNRPNPIGEKLREWRNDFIALDNQKQSDILLEILKLTTFDNSGADLRAIGGKNQSGVSTIGKKISSQKSVVLVHRSVTGIFEKQVDLLSI

SEQ ID NO: 625 - protein, 103 aa, Rhizobium etli
MSGEQLTREIGRSGVKASAVGLGTWAIGGWMWGGTDEAQSIAAIQASLDAGVTLIDTAPAYGLGRSEEIVGKALAGRRDKAVIATKCGLVWHTQKGNHFFDQD

SEQ ID NO: 626 - protein, 1059 aa, Unknown
  Rhodovulum sp. PH10
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 627 - protein, 1405 aa, Riemerella anatipestifer
MKTILGLDLGTNSIGWALVKEAENSNEKSEIIKLGVRVNPLTVDEKTNFEAGRPLSTNADRTAKRSARRNLQRYKLRRKNLIDLLIKNQLIDKDTPLTEIGKNTTHQTLELRAKAARERIELEDLARVFLAINKKRGYRSSRKVNNEEEGQAVDGMAVAKKLYDENLTPGQYAYELLSKGKKYVPDFYRSDLQAEFNAIWEYQKQFYADILDDELYNALKGQGQQNSRKRFLAIKGVYTAENKGKRDDVKLRHYKWRSEAISKKINIEEVAYVLVEINNDLNKSSGYLGAISDRSKELYFNKETVGENLWKQIQKNPHTSLKNQVFYRQDYLDEFEQIWETQAQFHPQLTLALKEQIRDVIIFYQRKLKSQKGLLSFCQFESWEIERKDENGNVILNKTTQLPKRQTVGRRVAPKSSPLFQEFKIWQNINNLEVTKISEGASKNKKETETLSDDERKLLFEELNLRGNLSQKEVLQILGLKDKEYKTNFSEGLEGNRTNAALFNIYQQIAENEGYGFDWSKKSAQEIKEELKAVFPQIGIQADILDFNANLDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRELLDKLELLPKNSLRNPVVEKILNQMVNVVNQVIETYGKPDEVRIELARELKKSAEKRAEMTKSINEATRRNEDIKKLITKDFGIPNPTKSDVVRYRLWEELAPLAYKDVFTGKQIKKEDLFSSKIDIEHIIPKALLFDDSFSNKTLVFRETNLKKADRTAYDFIESDYNATLDDYIQRVETLYNNTKGTISKGKRNKLLMAQKNLPDGFIERDLRNSQYIAKKAKAMLYQVFKDVNVTSGSITDRLREDWDLINVMKELNFPKYKALGLTEIEERYDIGQEKTKRVEVITDWTKRNDHRHHAMNALTVAFTTSSHIQYLNYLNARKNESHKEHKNIKGIENKITHKQKDKRKFIPPMPNFREEAKKHIETILVSIKNKNKVYTKNINKTKKKSGHNTKEQLTPRGQLHKETVYGKSKRPMSKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKKKGICIKRVTITGVSNAEALHHQKDHLGREILDDNGNPIPADFVSTGNNHHLAVYLDSEGKLQDNIVSFYEAVVRTSQGLPVVDKGLNKDLGWKFLFSLKQNEMFVFPNDDFDINDFDLLDDKKAELISKHLYRVQKISKVSAGNSFVRDIVFRHHLETTVKEVKELKDISYIQLKSLEGLRNIKKVRINHIGKIVQVGEY

SEQ ID NO: 628 - protein, 1145 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKCHYLKMVNL

SEQ ID NO: 629 - protein, 1400 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKEKGICIKRVTITGVSNAEALHHQKDHLGREILDDNGNPIPADFVSTGNNHHVAIYEDEKGKLQEKVVSLYEAVARANQGLPVVDKGLNEDLGWKFLFTMKQNEMFVFPNDDFDVNDIDLLDENNAKIISQHLFRVQKLATKNYMFRHHLETNVQEVKELNDIAYKSIRSTEPLKNIKKVRINHIGKIVQVGEY

SEQ ID NO: 630 - protein, 1128 aa, Roseburia intestinalis
MDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRIGCSWSEKGYILTPRNKAENYQHTMLRAMLVEEVKEIFSSQRRLGNKKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTANKPYSEWRTMEDKDFLFSLYSRDLVHIKSKKGIPIKNVDGSLGESKEVYAYYIGADISGAKIEGKAHDSRYTFRGIGVQKLELIEKCQVDILGHISTVKNEKRMGFS

SEQ ID NO: 631 - protein, 1471 aa, Scardovia wiggsiae
MGYKAPRNDKGEIDYGVGLDLGNGSVGWVAMDKDYHLIRARGHELIGARLFDPANSAENRRESRTTRRRLSRRRWRLRMLDSLFASELAKIDPNFLARRKYSWVHPKDEQNHENWYGSIIFGSKEQDKQFYKDYPTIYHLRKKLTEDTERHDIREIYVAIHHIVKYRGHFLREGEINSENLFDPEGFVELIKDVIKLNNSYDESTPIFEASPADVSEALLNEHTSRSGRIEDTLDKLDFSVSRVDKHELKGMRDAAKAVIGAIVGNTADFSKIFNLDNLDKDSKDNLKLKFADSNFDEKYGGVVGSGLLDETQIELVDRIHAVYDAVALKGILGDAHTISEAKVESYEKHRKNWKLIKEELRTKENKDEVDLWYGDLSGRQYKNPPDPEKGPDEGSKKDSPIRDSDQKQNLIKKANDYFTELIDDSQLSEEQKNCLKNDINNGQLFPVQRSSDNGVIPYQIHLNELRRIIENQKQYYPFLAETFIRKTAEGKSYEENKIVALLKFRVPYYVGPLVSKEDMEEHSSGNSAYHWMARNPGRGEAITPWNFDEVVDKDESGARFISRLTGTDTYLLGEPTLPQHSLLYEEYMVLSELNNVRLNVRQGNHWSDKNRQRLSYKQKEFLIENLFKEHKTVTRKRAEDCLSSMGCGEVQLFGLSDEKKFASSLSSYITLKKILGKAFVDDSGNSAILERIIEVQTVFEDREPLTHQLSLIDSLTVEQRKQLAKIHYTGWGKLSRKLLTSKKGSYKIHSQNEIMRTQHSIIDIMRGDSLNLIEIIRDKKIGIGEWIDNENLDRETGESDVSRLESVFEGIVMSPRVKRGVVQAVRVIDDLAKAIGNPPQRIFIEMADEVQASQRTVSRLSRLKALYGSPSLQKEFNDLKDLRKSLNETKDADLQEDRLYLYYIQLGKDLYTGKEISIDSLSSAYDIDHIVPQALTQDDSIDNRVLVSRKENARKTDSYLYTPDLIKNMRPLWGKLLAAGLMSQKKYDALTRVDDFKDREKQRFVQRSLVETRQIMKNVSTILRTYYGEDTNVVTLKSSITHDMRKYLGFPYKNRDINDYHHAQDALCISAAGQFMLNRHFVSGGEVTDGASNAYNMYLAEYLQEFRDAKARGERKRSTAFGFVVGSMSSKDDEKRTDHRTGEIVWSETNAEYLRKVMNYKKMLITQKVGDVKTRALYDETRYGHKESSAKSIKFDNLRRDTSLYGGFSGASTAYMMLVEYKKKNKLVSITAQEASLLAVADQKNDTVSVMDGILASHGLSGAKILLPKIVTGQLLDYSDALVTLQSASELNTARQMWLPRNDYNDIDIILKSKDIEDAAHKLGYDSDTVHVLRRIQKLFEAVFRVAESQFPLHQLSKDQQEEILRDPQNYGFGSAVKLLGGLLKALHANAENTNLAGLVKVLHGDKEYSDDGKAKEFKKFGFSPRWRRISNPTGFTLSDSDTFIYQSPSGIFEQRVTVKELKEKADKQK

SEQ ID NO: 632 - protein, 116 aa, Sphingobacterium spiritivorum
MFRKYFEEKNSARLLFTLKQGDFVYVPDDNEEVILDESSPLFIDYWKNISERSNNIHVVQKFSGKEIYFLKHTIADTIAKKIEFGSQDCYQSLNGKSIKEFCIKIDSDRLGNISKV

SEQ ID NO: 633 - protein, 1306 aa, Sphingobacterium spiritivorum; identical to SEQ ID NO: 93

SEQ ID NO: 634 - protein, 1110 aa, Unknown
  Sphingobium sp. AP49
MAEGKKRIWRLGADLGANSLGWAAIELSAPVNGKPIAILAAGSRIFSDGRDPKSGASLAVDRRDARAMRRRRDRFKQRQKALIKYLIADGLFPADEAARNAMAAIDPYAVRARALDEALSLPELGRALFHLNQRRGFKSNRKADRKADDDAGKIAIGIDRTRDAIAEDEADAGAEPGSWTFGKWLHERRLKGQSVRTRLRPESGEDAKGDGYDFYPDRALMEEEFDAIWAAQAPHHPDVLTNDVHDRLHEIIFYQRPLKAPQVGMCSLIPGDRRLPKAHPLFQRRRLLEELNALMIVRPGEVAQRLTREERDILLLKLKDKNKVSFATLRKALKLDPDARFNKESEDRTDLKGDEVAAVMGSKTRFGNLWVHLSIEAQWDVLARLDAVESDAEDAAFCAWLVETYALTPEQARAVANAPLPPGYGRFGETATRKLIEALRDGKKDDRVLVYSEAVTEAGLGHHSDRRTGEVFEDAKGRPQLPYYGVALERHIMPGTGDPSDPEEMRVGRLTNPTVHIGLNQLRRILNVLIRAYGPPAEIAIELARELKLTDEDKKRINRENNDNRIAAERRSEKLLAIGQADSGANRALLKLWEELNPANVLDRRCIYSGRQISIDMLFSAAVEVDHILPFAATLDDSNGNKIVCLREANREKRKRSPHDAWGHSARWDEIAARAAQLPRNKRWRFEPDAMDKFRDEGGFQARHLVDTQYLARLSREYLATLYPEKGEGSGHIWVSPGRLTEMVRRKLGLNDLLPDHNFGGGADQAKNRLDHRHHAIDAVVVAIVDRGMLNAIARASGQEGAEGRERIIIPEPWDGFRDALRETVNRITVSHRTDHGTASKAGLPKGKDATAGRLHNDTAYGFTGDTDAKGNSIVVRRVPLSSFKKLADLDRIRDADLKAALYQHLNGLEGKAFEKALAEFHKLEWHNFGGVRRVRVTEPLTVIPIKDRNGRIYKGYKGDSNYRYDVWELPDGKWVTNWKNEAGEAMSSVISMFDAHQSSEPPRPHPAARKILSLHQNDLLAIEREGEDRKLMRVVKFGQSGQITLAEHQQAGDLKKRDAVSNDDDPFKYFAPTSGGLKKVKARQVRIDEIGRVLDPGFPARTARRKTRG

SEQ ID NO: 635 - protein, 1084 aa, Sporolactobacillus vineae
MKYSIGLDIGISSVGWSVINLDRERIELMGARLFDAAENPKNGSSLAAPRRDARSARRRLRRRRYRVGRVRHFIIDRGLVTRGQADQLFDWKDGDLDIWLVRVNALERLLTDREFARVLIHIAKNRGYRSNRKSEAKSGENGQVLSAIKANKELMEEKGYQTVAEMLVNEPETFAGRKRNRGGEYTHVIARSELEHEIRLIFTKQRAFGNRFATEENENTYVKIWAAQRPVATKDDILKKIGDCTFEKGEKRAPKASYAFQYFRALDKLNRLRILSVREPSRNLTDDERNLIVPALFNHDKQKYSDLRKILQLRDDQKFNELFYDPGKSLKENENKTFLSLAEQYKIRKVIRDVQGKDGLLQYRPLDIDTIAYALTVFKDDQDTRDYLSNTFVNGNGKQVLNLANRAFDAELIDGLLSLSFAKFGHLSLKALHKLIPHMEQGLSYYDACKKVGYHDNEQVGKSKQHLLPVIPADEIRNPVVVRSLSQTRKVINAIIKRYGSPTFMYIELAREMGRPYNERRDLEKQYNKNRTVNDSAIEQIHELYPEIGAPRGHDILKYKLWQQQDCKCAYSLEKIPAEKIFEPGYAEVDHIIPYSRSFDDSNSNKVLVLSRMNQEKKNRTPYEWFGGDEHRWNKFESYVNALKVNRKKKSLLTKKNMDTEEEDTFKSRHLNDTRYITRFIKSFVEDNLLFREIEGAKQHVFTVNGAYTSLMRKRWGFNKNREESDLHHSVDAVIIAVSQPFRNEVSRYFKHREISLPQLLKRTWDYFPEPWEGFVKELRARTLQDPEKLKLALESLDLDSYDPEFIDEVKPIFISRMPKRSIKGQIHDETLRRNRGKTKDGFVKIVTRTRLENIKFDKNGDFPMYGRESDPKTYQAIKQRYLENNKDKKKAFIEPLYKPAKNPNNASLIRSVKIEDKANQIVPLRDEAVAYNASIVRTEVYRNKETGKFYLAPVYVSDVFAGREPRRFIRANVPYEQWVNITDKFTFLFNLYPNDVIYIKMKKVKTTKSNINKTISWQESYFYFKGTDIHTGAITIIDHMNSFTDRVGTQGLQLFEKYQVDPLGNLSRVHGETQYGVPALSHS

SEQ ID NO: 636 - protein, 475 aa, Staphylococcus massiliensis
MGQDYILGLDIGITSVGYGLIDYHDKSVIDAGVRLFKEANVENNEGRRSKRGSRRLQRRRKHRLARTRNLLESYQLNPFPKCEKNPYEIRVKGFKEVLTSDELSAALLHLAKRRGIDNVHVTDTESDSSDNGLSTKEQLAKNQKALESRYVCELQLERLLNDNKVRGANNRFKTQDFVREAKQILSIQKDHHNLDQVFIDKYISLLETRREYYEGPGKGSPYGWDGDIKKWYELLMGRCTYFPESLRSVKYAYSADLFNALNDLNNLVIVRDENDKLTYPEKYHIVENVFKQRKKPTLKQIAKEIDVAPEDIRGYRVTASGTPVFTSFKLYHDIKSVTSNDKVLEDTELLDAIAEVLTIYQSPIEVQEKLESLNVILTKEEIEGISKLTGYTGTHALSLKAIQIVIDELWETNDNQMTIFTRLNMKPQKVDLAKANKIPTSLVEDFIISPVAKRAFIQSIKVINAVIKNMVCLKI

SEQ ID NO: 637 - protein, 581 aa, Staphylococcus massiliensis
MPKDIIIELAREKNSDEERKIIRDVQKRNQQTRDLVDKVIKETGKTKAKGMVEKLILHDKQEGKCLYSLKSIPLEDLLNNPHHYEVDHIIPRSVSYDNSMNNKVLVLQEENSKKSNQTPFQYFNSSNTHITFKQFKQHVLNLSKTKDRITKKKKEYLLEERDINKFSVQKEFINRNLVDTRYATRELMTLLRAYFSANELDVKVKAINGGFTSYLRKRWDFKKDRNAGYKHHAEDALIIANVDFIFKQLKALDNAKKVMEGRKVQVEKDNVEDNEHYESLFREPDQIKEIKLYDNYKFSHRVDKKPNRELINDTIYSTRKVDNKTYTIQTVNNIYDKQNDQLKKLFNKSPEKFLMYKHDPKTFDKLATIMRQYKNEKNPLYKFHDETGEYLTKYAKKDNGPIVKSLKYIGKQVNAHLDITNDYENSNNKVVKLSLKPFRFDVYLDDGKYKFVTVKYLDIIKKDTYYVIDEEKYKLALQQKKISENAKFIGSFYNNDLIKINGELLRVIGVNDDAKNTLELNMIDISYRDYVENMNLATTPRIRKNIGKSITILEKYTTDILGNTFKISSPEKPQFIFKVRD

SEQ ID NO: 638 - protein, 1334 aa, Staphylococcus pseudintermedius; identical to SEQ ID NO: 200

SEQ ID NO: 639 - protein, 1112 aa, Staphylococcus simulans; identical to SEQ ID NO: 247

SEQ ID NO: 640 - protein, 773 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQ

SEQ ID NO: 641 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 642 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 643 - protein, 1378 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHHEDLKHLKQFVKASLPENYREVFADSSKDGYAGYIEGKTSQEAFYKYLLKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIIQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLGNLKSNILEEKKPKYVKDQVENHHLSDDRLFLYYLQNGKDMYTDDELDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNTSAFLESKGYLNIRDDKLMILPKYSLFELENGRRRLLASAGELQKGNELALPTQFMKFLYLASRYNESKGKPEEIEKKQEFVNQHVSYFDDILQLINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 644 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 645 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 646 - protein, 1370 aa, Streptococcus agalactiae
  MISC_FEATURE (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 647 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 648 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 649 - protein, 1370 aa, Streptococcus agalactiae
  MISC_FEATURE (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 650 - protein, 1125 aa, Streptococcus anginosus
MNGLVLGLDIGIASVGVGILNKETGEIIHANSRIFPAATADSNVERRGFRQGRRLGRRKKHRSARLNNLFEEFGFITDFSAIPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLSPEQKRQIVEYARTAKTLGTPTLLKYIAKLVDGSIDDIKGYRIDKSDKPEMHTFDAYRKMRTLDLVNIDALSRETLDDLAHILTLNTESEGILEALNSKMPSTFTKEQIDELIQFRKKNSAVFGKGWHNFSLKLMNELISELYETSEEQMTILTRLGKQRSREISKRTKYIDEKELTEEIYNPVVAKSVRQAIKIINEATKRYGIFDNIVIEMARENNEEDAKKDYIKRQKANQDEKNASMEKAAFQYNGKKELPDSIFHGHKELATKIRLWHQQGERCLYTGKNISIRDLIHNPHQYEIDHILPLSLSFDDGLANKVLVLATANQEKGQRTPFQAIDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQFVDPETGEILSLTDDEYKELVFRPPYDYFVDTLKSKSFEDSILFSYQVDSKYNRKISDATIYGTRKAQLGKDKQEETYVLGKIKDIYSQKGYEDFIKRYNKDETQFLIYHKDPQTFEKVIEEILKTYPDKELNEKGKEIPCNPFEKYRQENGPIRKYSKKGKGPEIKSLKYYDNKLGNHIDITPVNSQNQVVLQSLKPWRTDVYFNPRTSKYELMGLKYSDLRFEKGSGSYGISPEKYNKVKAKEGVNEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKF

SEQ ID NO: 651 - protein, 1386 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 652 - protein, 1396 aa, Streptococcus anginosus
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 653 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 654 - protein, 1345 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 655 - protein, 538 aa, Streptococcus dysgalactiae
DYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIRLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 656 - protein, 1155 aa, Streptococcus dysgalactiae
MDKKYSIGLDIGTNSVGWAVITDDYKVPSKKFKVLGNTDRHSIKKNLIGALLFDSGETAEATRLKRSARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNRRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKYQSYKMEK

SEQ ID NO: 657 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 658 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 659 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKPINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 660 - protein, 1370 aa, Streptococcus gallolyticus; identical to SEQ ID NO: 204

SEQ ID NO: 661 - protein, 1375 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 662 - protein, 1368 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 663 - protein, 1392 aa, Streptococcus mitis
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPGFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 664 - protein, 1134 aa, Streptococcus mutans
MANGKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNMRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIVKLVGCSADDIKGYRIDKSDKPEIHTFEAYRKMRTMELIKVDDLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKKAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKSYVKGLKTLSNKKKDYLLTEENIDKIEVKQKFIERNLVDTRYSSRVVLNALQDFYKERKFDTKISVVRGQFTSQLRRKWRIEKTRETYHHHAVDALIIAASSQLNLWKKQNNPLISYKEDQFVDPETGEILSLSDDEYKKLVFKAPYEHFVDTLKSKKFEDSILFSYQVDSKYNRKISGATICGTRKAQLGKDTQEETYVLGKIKDIYSQKGYEDFIKKYKKDKTQFLMYHKDPQTFEKVIEEILKTYPDKELNEKGKEVSCNPFEKYRQENGPVRKYSKKGNGPEIKSLKYYDEVLGKNIDITPKNSLNKVVLRSLNPWRTDVYFNHETRKYEFLGLKYSDLRYLKGEHRYGILIGDYKKIKDKEGIEKESEFKFTLYKNDLILIKDTAKGKEELFRFWSRTGKDNAKTFEKNKIELKPYSKSQFEKGEDTNVLGKLYASSNQLQKSFGTLENLSIYKVRTDVLGNKYFIKKEGDKPQLNFKKKL

SEQ ID NO: 665 - protein, 1134 aa, Streptococcus mutans; identical to SEQ ID NO: 664

SEQ ID NO: 666 - protein, 1128 aa, Streptococcus mutans
MANSKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNIRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIAKLVGCSADDIKGYRIDKSDKPEIHTFEAYRKMRTMELIKVADLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKEAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKAYVKGLKTLSNKKKDYLLNEEDINKNEVKQKFIERNLVDTRYSSRVVLNTLQDFYKKREFDTKISVVRGQFTSQIRRKWRIEKTRETYHHHAVDALIIAASSQLNLWKKQNNPLISYKEDQFVDPETGEILSLSDDEYKELVFKAPYDHFVDTLKSKKFEDSILFSYQVDSKYNRKISDATIYGTRKARLGKDSQEETYVLGKIKDIYSQKGYEDFIKKYKKDKTQFLMYHKDPQTFEKVIEEILKTYSDKELNEKGKEVPCNPFEKYRQENGPVRKYSKKGNGPEIKSIKYYDNKLGNHIDITPNNSHHQVVLQSLKPWRTDVYFNPKSGKYELMGLKYSDLRFEKVSGDYGISVKKYNEIKSKEGVDENSEFKFTLYKNDLILIKDTESGEQELFRFLSRTMPNQKHYVELKPYDKSKFEGHQKLMDIFGEVAKGGQCLKGLNKSNISIYKVKTDVLGNKYFIKKEGDQPQLNFKKKI

SEQ ID NO: 667 - protein, 1128 aa, Streptococcus mutans; identical to SEQ ID NO: 666

SEQ ID NO: 668 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 669 - protein, 1338 aa, Streptococcus mutans; identical to SEQ ID NO: 668

SEQ ID NO: 670 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 671 - protein, 1345 aa, Streptococcus mutans; identical to SEQ ID NO: 670

SEQ ID NO: 672 - protein, 1229 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNIQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHY

SEQ ID NO: 673 - protein, 1229 aa, Streptococcus mutans; identical to SEQ ID NO: 672

SEQ ID NO: 674 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 675 - protein, 1350 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYSFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRIRKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 676 - protein, 1350 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRICKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 677 - protein, 1345 aa, Streptococcus mutans; identical to SEQ ID NO: 674

SEQ ID NO: 678 - protein, 1350 aa, Streptococcus mutans; identical to SEQ ID NO: 675

SEQ ID NO: 679 - protein, 1350 aa, Streptococcus mutans; identical to SEQ ID NO: 676

SEQ ID NO: 680 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 681 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 682 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 683 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 684 - protein, 1345 aa, Streptococcus mutans; identical to SEQ ID NO: 680

SEQ ID NO: 685 - protein, 1345 aa, Streptococcus mutans; identical to SEQ ID NO: 681

SEQ ID NO: 686 - protein, 1345 aa, Streptococcus mutans; identical to SEQ ID NO: 682

SEQ ID NO: 687 - protein, 1345 aa, Streptococcus mutans; identical to SEQ ID NO: 683

SEQ ID NO: 688 - protein, 1345 aa, Streptococcus mutans; identical to SEQ ID NO: 681

SEQ ID NO: 689 - protein, 1345 aa, Streptococcus mutans; identical to SEQ ID NO: 681

SEQ ID NO: 690 - protein, 1345 aa, Streptococcus mutans; identical to SEQ ID NO: 681

SEQ ID NO: 691 - protein, 1345 aa, Streptococcus mutans; identical to SEQ ID NO: 681

SEQ ID NO: 692 - protein, 1359 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADKKLRKRSGKLATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKNLDHDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 693 - protein, 1359 aa, Streptococcus mutans; identical to SEQ ID NO: 692

SEQ ID NO: 694 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 695 - protein, 1355 aa, Streptococcus mutans; identical to SEQ ID NO: 694

SEQ ID NO: 696 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 697 - protein, 1345 aa, Streptococcus mutans; identical to SEQ ID NO: 696

SEQ ID NO: 698 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 699 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 700 - protein, 1345 aa, Streptococcus mutans; identical to SEQ ID NO: 699

SEQ ID NO: 701 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 702 - protein, 1345 aa, Streptococcus mutans; identical to SEQ ID NO: 701

SEQ ID NO: 703 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 704 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 705 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 706 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 707 - protein, 1345 aa, Streptococcus mutans; identical to SEQ ID NO: 706

SEQ ID NO: 708 - protein, 1345 aa, Streptococcus mutans; identical to SEQ ID NO: 703

SEQ ID NO: 709 - protein, 1345 aa, Streptococcus mutans; identical to SEQ ID NO: 704

SEQ ID NO: 710 - protein, 1345 aa, Streptococcus mutans; identical to SEQ ID NO: 705

SEQ ID NO: 711 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 712 - protein, 1345 aa, Streptococcus mutans; identical to SEQ ID NO: 711

SEQ ID NO: 713 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 714 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 715 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 716 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 717 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 718 - protein, 1345 aa, Streptococcus mutans; identical to SEQ ID NO: 717

SEQ ID NO: 719 - protein, 1345 aa, Streptococcus mutans; identical to SEQ ID NO: 713

SEQ ID NO: 720 - protein, 1345 aa, Streptococcus mutans; identical to SEQ ID NO: 714

SEQ ID NO: 721 - protein, 1345 aa, Streptococcus mutans; identical to SEQ ID NO: 715

SEQ ID NO: 722 - protein, 1345 aa, Streptococcus mutans; identical to SEQ ID NO: 716

SEQ ID NO: 723 - protein, 1345 aa, Streptococcus mutans; identical to SEQ ID NO: 715

SEQ ID NO: 724 - protein, 1345 aa, Streptococcus mutans; identical to SEQ ID NO: 715

SEQ ID NO: 725 - protein, 1345 aa, Streptococcus mutans; identical to SEQ ID NO: 715

SEQ ID NO: 726 - protein, 1345 aa, Streptococcus mutans; identical to SEQ ID NO: 716

SEQ ID NO: 727 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 728 - protein, 1345 aa, Streptococcus mutans; identical to SEQ ID NO: 727

SEQ ID NO: 729 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 730 - protein, 1345 aa, Streptococcus mutans; identical to SEQ ID NO: 729

SEQ ID NO: 731 - protein, 1350 aa, Streptococcus mutans
MKKPYSIGLDIGTNSVGWAVVTDDYKVPAKKMTVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKTPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 732 - protein, 1350 aa, Streptococcus mutans; identical to SEQ ID NO: 731

SEQ ID NO: 733 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 734 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 735 - protein, 1345 aa, Streptococcus mutans; identical to SEQ ID NO: 734

SEQ ID NO: 736 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 737 - protein, 1345 aa, Streptococcus mutans; identical to SEQ ID NO: 736

SEQ ID NO: 738 - protein, 1355 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLNKLGGD

SEQ ID NO: 739 - protein, 1355 aa, Streptococcus mutans; identical to SEQ ID NO: 738

SEQ ID NO: 740 - protein, 1125 aa, Streptococcus mutans
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLEAAKLLKEIAKLVGCQVEEIKGYRLDNKDKPDLHTFEPFRKLKSNLTTIAVENLSITTLDTLAHILTLNTEREGIEEAIQKELPNIFSDEQITGIIAVRKKNSQIFGKGWHSFSIKLMKELIPELYETSEEQMTILIRLKKVKTNSKITNRTKYINEQEVTDEIYNPVVSKSIRQTVKIINAAIKKYGAFDQIVIEMPRESNEEDERKFIADLQKSNAKEKDDAMKQAALLYNGKAELPHGVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 741 - protein, 1125 aa, Streptococcus mutans
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLGAAKLLKEIAKLVGCQVEEIKGYRLDNKDKPDLHTFEPFRKLKSNLTTIAVENLSITTLDTLAHILTLNTEREGIEEAIQKELPNIFSDEQITEIIAVRKKNSQIFGKGWHSFSIKLMKELIPELYETSEEQMTILTRLKKVKTNSKITNRTKYINEEEITDEIYNPVVSKSIRQTVKIINATIKKYGAFDQIIIEMPRESNEEDERKFIADLQKSNAKEKDDAMKQAALLYNGKDELPHDVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 742 - protein, 1125 aa, Streptococcus mutans; identical to SEQ ID NO: 741

SEQ ID NO: 743 - protein, 1125 aa, Streptococcus mutans; identical to SEQ ID NO: 740

SEQ ID NO: 744 - protein, 670 aa, Streptococcus oralis
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIGKIDKNFYRRLDESFRVLGDKSEDIQIKQPFFGNKELETAYHKKYPTIYHLRKHLADADKNSPVADIREVYMALSHIFKYRGHFLTLGKIDPNNINMQNSWIDFIESCQDAFDLEISDESKTIAAIFKSSDNRQEKVKGILSYFQPELAKKDKSIFKQLLQLLFGLKTKFKECFELEEEPDLNFSKENYDENLENLLGTLEEDFPDVFAKLKILRDTILLSDMLTYTGATHARFSATMVERYEEHRKDLQRFKSFVKQNLSEQDYLDIFGRKTPNGFDVDKETKGYVGYISNKMVLTNKQKTIQQNFYDYISGKITGIEGAEYFLNKISDGTFLRKLRTTDNGTIPNQIHAYELEKIIERQGRDYPFLLENKDKLLSILTFKIPYYVGPLAKGNNSRFAWIKRTTSQDVLDNNDEDTKNGKIRPWNYHKLINMDETRDAFITNLIGNDIILLNEKVLPKRSLIYEEVMLQNELTRIKYKDKYGKIHFFDSELRQEIINNLFKTNSKRVSSAMLLAYLENFTNLQAVEIVSGIEKGKSLNSTLKTYNDLKTIFSEDLLDSEIYQKELEEIIKVITVFV

SEQ ID NO: 745 - protein, 1373 aa, Streptococcus oralis
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 746 - protein, 1371 aa, Streptococcus oralis
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 747 - protein, 1121 aa, Streptococcus oralis
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKCRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKEYELMGLKYSDLSFEKGSGKYSISNEKYNSIKRIEGVNEQSEFKFTLYKNDLILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 748 - protein, 1134 aa, Streptococcus oralis
MNGLVLGLDIGIASVGVGILEKNSGKIVHASSRIFPAATADNNVERRKNRQARRLHRRKKHRGARLKDLFEYYGLLTDFSKVSINLNPYRLRVDGLDQQLTNEELFIALKNIVKRRGISYLDDASEDGGTVSSDYGKAVEENRKLLAEQTPGQIQLERFEKYGQLRGDFTVVENSEKCRLINVFSTSAYKKEAERILRKQQEFNNQITDEFIEDYLKILTGKRKYYHGPGNEKSRTDYGRFRTDGATLDNIFGILIGKCTFYPNEYRASKASYTAQEFNLLNDLNNLTVPTETKKLSEEQKKTIIEYAKSAKTLGASTLLKYIAKMIDASVDQIRGYRVDVNNKPEMHTFEVYRKMQSLETISVGELSRNILDELAHILTLNTEREGIEEAINTKLRDSFSQDQVLELVQFRKNNSSLFSKGWHNFSLKLMMELIPELYETSEEQMTILTRLGKQKSKETSKRTKYIDEKEVTEEIYNPVVAKSVRQAIKIINEATKKHGIFDNIVIEMARENNEEDAKKDYIKRQKANQDEKYAAMEKAAFQYNGKKELPDNIFHGHKELATKIRLWHQQGEKCLYTGKSIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLVDTRYSSRVVLNALQDFYKNHNFDTTISVVRGQFTSQLRRKWGLEKSRETYHHHAVDALIIAASSQLRLWKKQNNPLIAYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKAGKLVDFNPFEKYRQENGPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQFFRFWSRTGKDNPKSFEKHKIELKPYEKAKFEKGEELEVLGKVPPSSNQFQKNMQIENLSIYKVKTDVLGNKHFIKKEGDKPKLKF

SEQ ID NO: 749 - protein, 550 aa, Streptococcus oralis
MYSLDKNGSPTPLYRDQLNQYEVDHIIPYSFLPIDSIDNKVLTHRENNQRKLDNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATIRKYLYSNIMRFFNNPDSKVSKDIWDCNRDLPIIKDIIYNSQVNFVKRTMIKKGAFYNQNPVGKFNKQIAANNRYPLKTKVSSLDTSIYGGYGPMNSALSIIIIAERFNEKKCKIETVKEFHDIFIIDYKKFNNDPFQFLNDTSENGFLKKNNINRVLAFYRVPKYSLMQKIDGTRMLFESKSNLHKATQFKLTKTQNELFFHMRRLLTKSNLMDLKSESAIKESQNFILKHKEEFDNISNQLSAFSQKMLGDTTSLKNLIKGYNERKIKEINSSEETIKYFYDNFIKMFSFVKSGAPKDINDFFNNKYTVARMRPKPDKKLLNATLIHQSITGLYETRIDLSKLGED

SEQ ID NO: 750 - protein, 1140 aa, Streptococcus parasanguinis
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 751 - protein, 1374 aa, Streptococcus pseudoporcinus
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 752 - protein, 1052 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 753 - protein, 1368 aa, Streptococcus pyogenes; identical to SEQ ID NO: 37

SEQ ID NO: 754 - protein, 1367 aa, Streptococcus pyogenes; identical to SEQ ID NO: 241

SEQ ID NO: 755 - protein, 1368 aa, Streptococcus pyogenes [sequence omitted]

SEQ ID NO: 756 - protein, 1370 aa, Streptococcus ratti
MKKPYSIGLDIGTNSVGWAVITDDYKVPAKKMKVLGNTDKNYIKKNLLGALLFDSGNTAEDRRLKRTARRRYTRRRNRLLYLQDIFSDEMNKVDESFFHRLEDSFLVSEDKRGDHHPIFGNVVDEVKYHEQFPTIYHLRKYLADTPEKADLRLVYLALAHMIKFRGHFLIDDPKLDVKNTDSQELFSQFLTAYDVTQEDSHLADVKINISDIITEKMNKSRKVEALLFHFPSQKKNSFFGNLVSLVFGLLPNFKTNFNLAEDAKLQLSKDSYDEDLENLLGQIGDEYTDVFVAARKLYDSILLSGILTVNDLSTKAILSASMVRRYEEHNKDLAKLKAFVKANFTHDVFKEVFSDASKNGYAGYIEGKTSQEDFYKYVKNLIGKVDGSADFIEKIDREDFLRKQRTFDNGSIPHQVHLAEMKAILRRQGEYYPFLKEHAEKIQQILTFRIPYYVGPLDRHGHSDFAWASFNSEEKVTPWNFEEIIDKNKSAQAFIERMTNQDLYLPNEKVLPKHSPLYEKYTVYNELTKIKYVTETGTAKFFDANLKQEIFDGLFKKERKVTKRKLLTFLEKNFDEFRIVDIQGLDKETETFNASYGIYQDLLKIIKDKAFMDDSENADILEDIVLTLTLFEDREMIKQRLAKYADLFDKKVIDNLARRRYTGWGRLSAKLLNGIRDKRSRKTIMDYLVDDGRSNRNLMQLITDDNLTFKDEIAKAQYSDNSDDLHQVVQDLAGSPAIKKGILQSVKIVDELVKVMGYEPEQIVVEMARENQTTAKGRRNSQQRYKRLEEAIKNLDRDLNYKILKEHPTDNQALQNDRLFLYYLQNGRDMYTGESLDINRLSDYDIDHIIPQAFIKDNSIDNRVLVSSAKNRGKSDDVPSEDVVNRMRPFWNKLLNCGLISQRKYSNLTKKELTPNDKAGFIKRQLVETRQITKHVARILDEHFNKEFDEDKKRIRKVKVVTLKSNLVSNFRKEFELYKVREINDYHHAHDAYLNAVVAKALLMKYPKLEPEFVYGEYPKYNSYRERKTATQRMFFYSNIMNMFKSKVKLADERIIERPMIEVNDETGEIAWDKTKHIATVKKVLSYPQINIVKKVEEQTGGLTNETIYPRGSFDKLLNRKNTLEASKYGGFGSPTVAYCVLVVADSKNENGKVKKLKLGSELLGITILEKNDFENNSLDFLSRKGYQGVQEKKIIKLPKYSLFEFQDGSRRMLSSVMANDNKRGDLQKANEMILPAYLVKLLYHAKHINSVGEPAHKNYINEHCSEFQDLLNYIRQFADKFVDVDKNLSKIRSLSKSMAEYSVSEICSSFVNLLTLTALGAPADFKFFGTTIPRKRYGSPQSILSATLIHQSITGLYETRIDLSKLGED

SEQ ID NO: 757 - protein, 1135 aa, Streptococcus salivarius
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLACDIADIKGYRIDKSDKAEIHTFEAYRKMKTLETIDIEQIEREKLDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFKAHKIDTKVSVVRGQFTSQLRRHWGIDKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYALGTKTPSKTGFYKFLDLYNKDKSQFLVYQKDRKTWDEVIEKIMEQYRPFKESDKNGKEVDFNPFEKYRIENGPIRKYSRKGNGPEIKSLKYYASKLGNHIDITPKDSNNKVVLQSVSPWRADVYFNKTTGSYEILGLKYADLQFEKGTGTYRISEEKYNDIKKKEGVDSDSEFKFTLYKNDLLLIKDTETKEQRLFRFLSRSMPNKKHYVELKPYSKDKFEKNESLIEILGSADKSGRCIKGLAKSNLSIFKVRTDVLGNQHIIKNEGDKPKLDF

SEQ ID NO: 758 - protein, 1127 aa, Streptococcus salivarius
MSDLVLGLDIGIGSVGVGILNKVTGEIIHKNSRIFPAAQAENNVERRINRQGRRLTRRKKHRRVRLNHLFEESGLITDFTNVSINLNPYQLRVKGLTDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITNVKNEKAMGPAKLFKYIAKLLSCDVADIKGYRIDKSDKAEIHTFEAYRKMKTLATIDIEQMERENLDKLAYVLTLNTEKEGIQEALEHEFADGTFSQEQIDELVQFRKANSSIFGKGWHSFSVKLMMELIPELYATSEEQMTILTRLGKQKTTSSSNKTKYIDEKQLTEEIYNPVAAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEIDHILPLSITFDDSLANKVLVYATANQEKGQRTPYQALDSMDDAWSFRELKAFVRDSKALSNKKKEYLLTEEDISKFDVRKKFIERNLVDTRYASRVVLNALQEHFRVHKTDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYSQTGYDAFIKIYKKDKSKFLMYRHDPQTFEKVIEPILENYPNKELNEKGKEVPCNPFLKYKEDHGYIRKYSKKGNGPEIKSLKYYDSKLGNHIDITPKNSNNKVVLQSVSPWRADVYFNKTTGKYEILGLKYADLKFEKGTGTYKISEEKYNDIKIKEGVDSDSEFKFTLYKNDLLLIKDTETKEQQLFRFLSRTMPNVKHYVELKPYDKQKFDDNEELIKILGIVAKGGQCKKGVSKPNISIYKIRTDVLGNQHIIKNEGDKPKLDF

SEQ ID NO: 759 - protein, 1385 aa, Streptococcus salivarius
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKVYHDEFPTIYHLRKHLADSSKKADLRLVYLALAHMIKYRGHFLIEGDFNSKNNDLQKNFQDFLDTYNAIFESDLSLENSKQLEEIVKDKISKSAKKDRILKLFPGEKNSGIFSEFLKLIVGNQADFRKYFNLDEKTSLQFSKESYDEDLETLLGHIGDDYSDVFLKAKKLYDAILLSGILTVTDNGTEAPLSSAMIMRYKEHEEDLALLKAYIRNISLETYNEVFKDNTKNGYAGYIDGKTSQEDFYVYLKRLLAGLEGADYFLEKIDREDFLRKQRTFDNGSIPYQIYLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYENFTVYNELTKVRFIAEGMRDYQFLDSKQKKDIVRLYFKGKRKVTDKDIIEYLHAIDGYDGIELKGIEKQFNSSLSTYHDLLNIINDKEFLDDSSNETIIEEIIHTLTMFEDREMIKQRLSKFDNIFDKSVLKKLSRRHYTGWGKLSAKLINGIRDEKSGNTILDYLIDDGVSNRNFMQLIHDDALSFKKKIKKAQIIGDKDNIKQVVKSLPGSPAIKKGILQSIKIVDELVKVMGREPESIVVEMARENQYTNQGKSNSQQRLKRLEESLKGLGSKILKENVPTRLSKIDNNALQNDRLYLYYLQNGKDMYTGEELDIDRLSNYDIDHIIPQAFLKDDSIDNKVLVSSASNRGKSDDVPSLEVVKKRKTLWYQLLKSKLISQRKFDNLTKAERGGLSQEEKAGFIQRQLVETRQITKHVARLLDERFNNKKDENNRTLRTVKIITLKSSLVSQFRKDFELYKVREINDFHHAHDAYLNAVVASALLKKYPKLEPEFVYGDYPKYNSFRERKSATEKVYFYSNIMNIFKKSIPLADGTVIDRPLIEVNEETGESVWNKVADLNTVRKVLSYSQVNIVKKVEEQNHGLDRGKPKGLFNANLSSKPKPNSKENLVGAKEYLDPKKYGGYAGISNSFAILVKGTIEKGAKKKITNVLEFQGISILDRIYYRKDKLNFLLEKGYKDIELIIELPKYSLFELSDGSRRMLASILSTNNKRGEIHKGNQIFISQKFVKLLYHAKRISSTFNENHRKYVENHKKEFEELFYYILEFNENYVGAKKNGELLKSAFQSWQNHSIDELCSSFIGPTGSERKGLFELTSRGGAADFEFLGVKIPRYRDYTPSSLLKDATLIHQSVTGLYETRIDLGKLGED

SEQ ID NO: 760 - protein, 1392 aa, Streptococcus sanguinis
MENKNYSIGLDIGTNSVGWAVITDDYKVPSKKMKVFGNTDKHFIKKNLIGALLFDEGATAEDRRLKRTARRRYTRRKNRLRYLQEIFSEEISKLDSSFFHRLDDSFLVPKDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFSDEKSTSLFSEFLKLIVGNQADFKKHFDLEEKAPLQFSKDTYDEDLENLLGQIGDGFTDLFLVAKKLYDAILLSGILTVTDPSTKAPLSASMIERYESHQKDLAALKQFIKNNLPKRYNEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKQTGDTILDYLIDDGKINRNFMQLINDDGLSFKEIIQKAQVVGKTDDVKQVVQELPGSPAIKKGILQSIKIVDELVKVMGYAPESIVIEMARENQTTARGKKNSQQRYKRIEDSLKNLAPGLDSNILKENPTDNIQLQNDRLFLYYLQNGKDMYTGKPLDIDQLSSYDIDHIIPQAFIKDDSIDNRVLTSSKDNRGKSDNVPSLEVVQKRKAFWQQLLDSKLISERKFNNLTKAERGGLDERDKVGFIRRQLVETRQITKHVAQILDASFNTEVNEKNQKIRTVKIITLKSNLVSNFRKEFELYKVREINDYHHAHDAYLNAVVAKAILKKYPKLEPEFVYGDYQKYDLKRYISRFKPSKEIEKATEKYFFYSNLLNFFKEEVHYADGIIVKRENIEYSKDTGEIAWNKEKDFATIKKVLSYPQVNIVKKTEIQTHGLDRGKPKGLFNSNPSPKPSEDSKENLVPIKQGLDPRKYGGYAGISNSYAVLVKAIVEKGAKKQQKTILEFQGISILDKINFENNKENYLLKKRYIEILSTITLPKYSLFEFPDGTRRRLASILSTNNKRGEIHKGNELVLPGKYTTLLYHAKNINKKLEPEHLEYVEKHRNDFAKLLECVLNFNDKYVGALKNGERIRQAFTDWETVDIEKLCFSFIGPENSKNAGLFELTSQGSASDFEFLGVKIPRYRDYAPSSLLKATLIHQSITGLYETRIDLSKLGED

SEQ ID NO: 761 - protein, 1377 aa, Streptococcus sanguinis
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 762 - protein, 1370 aa, Streptococcus sanguinis
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 763 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 764 - protein, 317 aa, Unknown
  Streptococcus sp. GMD4S
FEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 765 - protein, 1420 aa, Unknown
  Streptococcus sp. oral taxon 071 str. 73H25AP
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIEKIDKNFYRRLDESFRVLGDKSEDIQIKQPFFGNKELETAYHKKYPTIYHLRKHLADADKNSPVADIREVYMVLSHILKYRGHFLTLGKIDPNNINMQNSWIDFIESCQDAFDLEISDESKTIAAIFKSSENRQEKVKQILSYFQQELLKKDKSIFKQLLQLLFGLKTKFKDCFELEEEPDLNFSKENYDENLENLLGALEEDFSDVFAKLKILRDTILLSSMLTYTGATHARFSATMVERYEEHRKDLQRFKSFVKQNLSEQDYLDIFGRKTPTGFDVDKETKGYVGYISNKMVLTNPQKQKTIQQNFYDYISGKITGIEGAECFLNKISDGTFLRKLRTTDNGAIPNQIHAYELEKIIERQGRDYPFLLENKDKLLSILTFKIPYYVGPLAKGNNSRFAWIKRTTSQDVLDDNDEDTRNGKIRPWNYHKLINMDETRDAFIINLIGNDIILLNEKVLPKRSLIYEEVMLQNELTRVKYKDKYGKIHFFNSELRQEIINNLFKTNSKRVSSAMLLSYLENFTNLQAVEIVSGIEKGKSLNSTLKTYNDLKTIFSEELLDSEIYQKELEEIIKVITVFDDKKSIKNYLTKYFGHLEFLNEEKINQLSKLRYTGWGRYSGKLLLGIRDEDTGFNLMQFLRNDDENRNLTQLISDTTLSFDSAIKAIQSKSTVEDDVFEEIKNLAGSPAIKRGILNSIKIVDELVQIIGYPPQNIIIEMARENMTTEEGQKKAKTRKSKLESALKNIEDSVLESGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATLRKHLYSNIMRFFNNPDSKVSKDIWDCNRDLPIVKDVIYNSQINFVKRTMIKKGAFYNQNPVGKLNKQIAANNRYPLKTKVSSLDTSIYGGYGPMNSALSIIIIAERFNEKKGKIETVKEFHDIFIIDYEKFNNNPFQFLNNVSEEGFLKKNDLNRVLAFYRISKYSLMQKIDGTRMLFESKSNLHKVTQFKLTKTQNELFFHMKRLLTKSNLMDLKSESAIKESQNFIQTHQNEFDNIADRLSNYSQKMLGETKSLQTLINGYNERPIKQIDNNEETIRYYYDNFIKMFSFVKSGAPKDIINFFNDKYTVPRMRPKPDRKMLDATLIHQSITGLYETRIDLSKLGED

SEQ ID NO: 766 - protein, 1371 aa, Unknown
  Streptococcus sp. F0441
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 767 - protein, 93 aa, Unknown
  Streptococcus sp. BS35b
MILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 768 - protein, 1121 aa, Unknown
  Streptococcus sp. GMD6S
MNGLVLGLDIGIASVGVGILEKNSGKIIHANSRLFPAATADNNVERRKNRQARRLHRRKKHRGVRFQDLFEDYGLLTDFSKVSINLNPYRLRVDGLNQQLTNEELFIALKNIVKRRGISYLDDASEDGGTVSSDYGKAVEENRKLLAEQTPGQIQLERFEKYGQVRGDFTVVENGEKRRLINVFSTSAYRKEAERILRKQQEFNSKITDEFIEDCLKILTGKRKYYHGPGNEKSRTDYGRFRTDGTTLDNIFGILIGKCTFYPDEYRASKASYTAQEFNLLNDLNNLTVPTETKKLSEEQKKVIVEYAKEAKTLGASTLLKYIAKMIDASVDQIRGYRVDVNNKPEIHTFEAYRKMQSLETISVGELSRNVLDELAHILTLNTEREGIEEAINTKLKDSFSQDQVLELVQFRKNNSSLFSKGWHNFSLKLMMELIPELYETSEEQMTILTRLGKQKSKEISKRTKYIDEKELTEEIYNPVVAKSVRQAIKIINEATKKHGIFDNIVIEMARENNEEDAKKDYIKRQKANQDEKNAAMEKAAFQYNGKKELPDSIFHGQKELATKIRLWHQQGEKCLYTGKNIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 769 - protein, 1026 aa, Unknown
  Streptococcus sp. BS35b
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKRRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFIDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKKYELMGLKYSDLSFEKGSGKYSISNEKYNSIKRIEGVNEQSEFKFTLYK

SEQ ID NO: 770 - protein, 1377 aa, Unknown
  Streptococcus sp. C300
MNNKPYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLEEKAPLQFSKDTYDEDLENLLEQIGDDFADLFVAAKKLYDAILLSGILTVTDPSTKAPLSASMIERYENHQKDLAVLKQFIKTNLPEKYVEVFSDQSKDGYAGYIDGKTTQEAFYKYIKNLLSKFDGADYFLDKIEREVFLRKQRTFDNGSIPHQIHLQEMNTILRRQGEHYPFLKENKEKIEKILTFRIPYHVGPLARGNRDFAWLTRNSDQAIRPWNFEEIVDKASSAEDFINKMTNYDLYLPEEKVLPKHSLLYETFAVYNELTKVKFIAEGMRDYQFLDSGQKKKIINQLFKKKRKVTEDDIIDCLQKIDNYDGIELKGIEKQFNASLSTYHDILKIIRDKEFMDDPKNGDILENVIHTLTIFEDREMIKQRLAQYNSIFDEKVIKALSRKHYTGWGKLSAKLIDGIRDKQTGKTILDYLMDDGKSNRNFMQLIKDDELSFTEIIQKAQVVGDTDNLRQVVQNLPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGEALNINQLSSYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNKEVTEKNKKNRNVKIITLKSNMVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLIPIKSGLSPEKYGGYARPTIAYSVLVTYKQNNKIKNTMVGIPVLTKLEFERDPNLYLRNLGINNVSHVIKLVKYTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLSKLGED

SEQ ID NO: 771 - protein, 1371 aa, Unknown
  Streptococcus sp. oral taxon 056 str. F0418
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 772 - protein, 1139 aa, Unknown
  Streptococcus sp. C150
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLSCDVADIKGYRIDKSDKAEIHTFEAYRKMKTLETLDVKKMAREELDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFRTHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKDKSQFLMYQKDRRTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQIFRFWSRTGKDNPKSFEKHKLELKPYEKTRFEKGEELKVLGKVPPSSNRLQKNMQIENLSIYKVRTDVLGNQHIIKNEGDKPKLDF

SEQ ID NO: 773 - protein, 1375 aa, Unknown
  Streptococcus sp. M334
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 774 - protein, 206 aa, Unknown
  Streptococcus sp. GMD4S
RTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATR

SEQ ID NO: 775 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWDEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 776 - protein, 1381 aa, Streptococcus suis
MVKKKYAIGIDIGTNSVGWSIVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDRYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYEPEHIVVEMARENQFTNQGRRNSQQRINRLENALKDFGSKILEEQKPYGVSKVNNIHLQSDRLFLYYLQNGKDMYTDEELDIDHLSEYDIDHIIPQAFIKDDSLDNKVLTKSAKNRGKSDDVPSMEIVHNRKNFWRQLLKSKLISQRKFDNLTKAERGGLTNEDKARFIQRQLVETRQITKHVARMLDTRFNTKLDEAGNRIRDPKVNIITLKSNLVSQFRKDYQLYKIREINNYHHAHDAYINAVVATALLKKYPQLAPEFVYGEYPTYNSYNSRKSATEKVLFYSNIMNFFKRIVVHSKTGEVRIRPVIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVETHRHVFDELLIYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 777 - protein, 39 aa, Streptococcus thermophilus
GRCIKGLGKSNISIYKVRTDVLGNQHIIKNEGDKPKLDF

SEQ ID NO: 778 - protein, 302 aa, Streptococcus thermophilus
MIRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAERFILSKPIEK

SEQ ID NO: 779 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLGNHIDITPKDSNNKVVLQSVSPWRADIYFNNTTGKYEILGLKYADLQFEKGTGTYKISQEKYNDIKKKEGVDSDSEFKFTLYKNDLLLVKETETKEQQLFRFLSRTMPKQKHYVELKPYDKQKFEGGEALIKVLGNVANGGQCIKGLGKSNISIYKVRTDVLGNQHIIKNEGDKPKLDF

SEQ ID NO: 780 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKEYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASIQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPVNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 781 - protein, 1121 aa, Streptococcus thermophilus
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFVNRYLEILTGKRKYYHGPGNEKSRTDYGRYRTNGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILKRLGKQKTTSSSNKTKYIDEKLLTEEIYNPVVAKSIRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNDPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 782 - protein, 1122 aa, Streptococcus thermophilus
MSDLVLGLDIGIGSVGVGILNKVTGEIIHKNSRIFPAAQAENNVERRTNRQGRRLTRRKKHRRVRLNRLFEESGLITDFTKISINLNPYQLRVRGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKASSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKLSDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRADVYFNKTTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 783 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVCEINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 784 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 785 - protein, 595 aa, Streptococcus thermophilus
MVQFRKANSSIFGKGWHNFSVKLMMELIPELYETSEEQMTILKRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQFLDIETGELISDDEYKESVFKAPYQHFVDTLKSKEFEDSILFSYQVDSKFNRKISDATIYATRKAKLDKEKKEYTYTLGKIKDIYTQAGYDAFIKIYKKDKSKFLMYHHDPQTFEKVIEPILENYPNKEINEKGKEVPCNPFLKYKEEHGYIRKYSKKGNGPEIKSFKYYDNLLGRHIDITPKNSKNIVALRKLNPWRTDVYFNHETMKYEFLGLKYADISYKKSKNKAGDFLPK

SEQ ID NO: 786 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 787 - protein, 1038 aa, Streptococcus vestibularis
MIDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSEEQKNQIINYVKNEKAMGPAKLFKYIAKLLSCDIADIKGYRIDKSDKAEIHTFEAYRKMKTLETIDIEKMSREELDKLAYVLTLNTEREGIQEALEHEFVDGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARATNEDDEKKAIQKIQKANKDEKDAAMLKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKNKSQFLMYQKDRKTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQVFRFWSRTGKDNPKRFEKHKIELKPYEKARFEKGEELEVLGKVPPSSNQLQKNMQIENLSIFKVRTDVLGNQHIIKNEGDKPKLDF

SEQ ID NO: 788 - protein, 97 aa, Streptococcus vestibularis
MSDLVLGLDIGIGSVGVGILNKVTGEIIHKNSRIFPAAQAENNVERRTNRQGRRLTRRKKHRRVRLNHLFEESGLITDFTKVSINLNPYQLRVKIDR

SEQ ID NO: 789 - protein, 1084 aa, Unknown
  Subdoligranulum sp. 4_3_54A2FAA
MKNTLYGIGLDIGVASVGWAVVGLNGTGEPVGLHRLGVRIFDKAEQPKTGESLAAPRRMARGMRRRLRRKALRRADVYALLERSGLSTREELAQMFEAGGLEDIYALRTRALDEPVGKAEFSRILLHLAQRRGFKSNRRTASDGEDGRLLAAVNENRRRMAQGGWRTVGEMLYRHEAFALHKRNKADDYLSTVGRDMVAEEASILFERQRAMGCSWAAPELQAEYLSILLRQRSFDEGPGGNSPYGGNQVEKMVGRCTFEPDEPRAAKAAYSFEYFSLLQKLNHIRLAENGETRPLTQPQRQQLLSLAHKTPDISLARIRKELALPETVQFNGVRCRANETLEESEKKEKFACLPAYHKMRKALDGVVKGRISSLSISQRDAAATALSLYKNEDTLRAKLTEAGFQAPEIDALAGLTGFSKFGHLSLKACRKLIPHLEQGLTYDQACTAAGYDFKGHGAGERAFTLPAAAPEMEQITSPVVRRAVAQTIKVVNGIIREMDASPAWVRIELARELSKTFGERQEMDRSMRENAAQNERLMQELRDTFHLLSPTGQDLVKYRLWKEQDGVCAYSLRRLDVERLFEPGYVDVDHIVPYSLSFDDRRSNKVLVLSSENRQKGNRLPLQYLQGKRREDFIVWTNSSVHDYRKRQNLLREKLSGDEAEGFRQRNLQDTQHMARFLYNYISDHLAFAQSEALGKKRVFAVSGAVTSHLRKRWGLSKVRADGDLHHALDAAVVACTTDGMIRRISGYYGHIEGEYLQDADGAGSQHARTKERFPAPWPRFRDELIVRLSEQPAEPLLDINPEFYCEYGTEHIRPVFVSRMPRRKVTGPGHKETIKGAAAADEGLLTVRKALTELKLDKDGEIKDYYMPSSDTLLYEALKAQLRRFGGDGKKAFAEPFYKPKADGTPGPLVRKVKTTEKATLTVPVHGGAASNDTMVRVDVFLVPGDGYYWVPVYTADTLKPELPNRAVVQGKPYSEWKEMREEDFIFSLYPNDLVYVEHKSGLKFTLQNADSTLEKTRTQTSAFAYFVSGSISTASITIRTHDNAYGIPSLGVKTLKTFHKYQVDVLGNVFPVHKETRQKFR

SEQ ID NO: 790 - protein, 951 aa, Sutterella parvirubra
MPTVRPVFHSSASFDLGAKNTGLFLVNHPAGAAPSAEYAAAYTIVQPADGDGLNYSTTNRRAVRHRLRGGKRFKLARRLVLQVIDALRKLKPGLIRDEEMRRTVEALSSLLKRRGFTRIESEAQVDPTTLDSVDPAVFADHETLGGFFSLGIPISTQWDALSQNPGAVEQLFKALPSAKDFGKYVTEQFPEFAEQKKLYADAIKVLSSEAKSIVMQLGLGHHHRSKYFEMIAHDMLRDPRLQGVFELFGSEERFKTFICNVSNLQLRALRWYFDEPNPEVANQWNPEKFQVVWLRGLKYFHPDAERKADMKKLIDELTASKDILDALCTTDPRRTIPPYEDQNNRRPPFDQTLWLSAAELTRRYGDKWRIWSQKFERADRALSTGLDEILLYTDRRSRMFNRNQDPSVYADSYVLQRVLDRSSKLDRYALRALAAGYRTQELHEPLATLSDTLGTQHVETFLTFAAEYYEEVAAAKNGLWLDGPSRLLERADIHPPMKKKVLDLLLGNILDATPEIGRILRTVLWNRHVHEKSRSTPASLCRSIEAIRKDFGGEFRMRYDALDAKIRAAEDQKKKFKPTNAEEKDLFKAWNATKTMHAFLRDVLQLTPKQLERTASPYVFAQLHTLIDTERDGFTSTSLAAHLENHWRMRANAAGMAQCSRLPADAVRPFDGVLSKALDRQAFEAAKLAAQHLMSRKELTDTDIRYSIIIESNRFAFSASTAELKKNTLAKKNAEKGLNFELKRWQDKDSRIREASRGICAYTGAKLGDVVEYDHIIPRAFTTSAMGSVFNSEANLICVSRPGNQTKADKRYGLNKLHKTYLTAVFGTADVTTIAASIEDIVGKLASANRLRHFELLNEKEQDAVRHALFLDDESDARRIVLRELAAQNKSRVNGTQAWFVRAFMTKLLEITKDWRERTGNTLDIRSWKTDAEVASRLRSALNFHAEITLT

SEQ ID NO: 791 - protein, 406 aa, Sutterella parvirubra
SNLFREEVPYGDHFLPIIQMKNRIYIGYQLPKADGTGGNAVAVLGKDPLELLETLKPFLDREPQAFSDHPVTYKMINERAYELLTKCALTPDQTTELERTQAEVLRSLNYQTSRAAVLGRLVDDKNKFVAKDAVWKEKDFVISFKLSPKKSAFKASGQLELPAKSDWKALVDSPELAINWGQPADDTFSQRIERKVRMNSSHLEHTPKKRVVSLPVVDKPSGGFRIRRHNLDGSAVFQVHTVANNKYGGFSADSAGKVDWSTPVLCGHLQHANLVPLDPETASAEQLVRMSEWRVVETTSDIRLEVCPGTSGRRYVRVELPFTLLQEWLTAGKVADVPVSPLHLPGSIKLTDPKTFCAEAQKTLSIFAQPRATIFFEQLGDRVRFRFEASGGPATMNAAYNAAGRS

SEQ ID NO: 792 - protein, 389 aa, Sutterella wadsworthensis
MKACDLEEKTNHLQACVAIDLGARYTGTFSILHKSSHLPSKDDCRAATYVLPEDGGKMTYSQRNRTAVRHRIRGKKRFALARRMAMLIIREKLAAKSVTLTSSETRRLAEAVGSLLRRRGYNRLETETDNDLTVLENIEPEVFSEHEILGKYFYAGTDLAIQWETLSQDLSKISSLLAERLSEKDFKKYLTGLIPDDKNKIKHIISVFKMLIDEAESINMQCVLGHKHRTQYLSDIHADMHRDTRLSKAAEAFGGVDRLWRLLGNLSNLQLRAHRWYFNAPHLFDDQALEPARLQKTLVRAFKYLHCPQGVESRAQAELVKELEEADDIIDALCTIDPVRTIPPYENQQNRRPPFDQTLYLSPDLGVSGFLCLGRLFQGQPNEAALCFL

SEQ ID NO: 793 - protein, 976 aa, Unknown
  Tannerella sp. 6_1_58FAA_CT1
MKKILGLDLGSNSIGWALVNEAENRDEASSIIKLGVRVNPLTVDEMQNFEKGKSITTNADRTLKRSMRRNLQRYKLRRDALIKLLKKVGFITDGTILSEQGNRTTFETYRLRAKAPDEEISLQELARVLLMINKKRGYKSSRKIKEKEAGTLIDGMEVAKKLYDEDLTPGQLCLQLLESGKKSLPDFYSSDLQEEFDRIWNFQKQFNPKAFCDTAKEEIKGKNKSQTWAILAKYFIWMEEMDVWNEKESKTERVEKECKLVGLKRTVKKEEQRKENYCWRVQALTEQLDLEKVAVVLQEINGQISTSSGYLGAISDRSKVLYFNRQTVGQYQMAELEKNPNTSLRNMVFYRQDYLDEFDKIWEKQAEFHKELTVELKKEIRDIIIFYQRRLKSQKGLIGFCEFENREIMVEKNGKMQAKVVGCKVIPRSHPLFQEFKIWQTLNNVEVFAGEKKCKRKRTDAFPGLFDGTEDTLMVEGWRYLYQEEKEILAKELSVKKSLKKEYILKLLFDNPQDLDMNFEQIEGNDTGNVLFSAYSKMIEKYGYEPLDFGKPTDKIIEQLQVIFADLGWNTDLLFVDLNKEGKDLEKQPYFKLWHLLYSFEGDNTPTGNGKLVEKLMELCHVGKECALELVNISFQNDYGSLSAKAIKKILPYLKEGNRYDVACGYAGYRHSKSSLTKEEIENKVLKDKLDILPKNSLRNPVVEKILNQMVNVINAIIDTYGKPDEIRVELARELKKSAKEREELTKAIAKSTREHEEIRKVLQEEFGMINVSRNDIIRYKLYKELKDNGYKTLYSNQDIPKEKVFSKEIDIEHIIPQARLFDDSLSNKTLEYKAINIEKGNKTAYDFVKEKYGEKGLQQYLNRCESLFKGHRTKLRKLKMGQENIPEGFIDRDLRNTQYIAKKALAMLNEICRRVVATTGSITDRLREDWQLVDVLKELRCFRYFKDTKMKANHNKNIFYTSIKVDVSDTSKILK

SEQ ID NO: 794 - protein, 1049 aa, Tistrella mobilis
MINERLTFGIDLGIGSCGWAVLRHADAAGEPGVIEGLGSWCFDVPETSKERIPTNQVRRSNRLLRRVIRRRRNRMAEIRRLFHAQGLLPSADEDALKRPRLDPWELRARGLDQCLSAEEFAVALGHIARHRGFRSSAKRKAANTSGEDSKMLSALLVTRERTARYRTVGEMFARDPEYSARRRNRDGIFDRTVARDDLIHEVGKLFEAQRARGSAFASPDLEADFNAIAFRQAEMQDSERLVGNCPFERDEKRAARWAPSFERFRLLTRLINLRIATAEGERRFTPEDLARVSAELGATAKLPVSRVRALIGLLPDERFTTIRVEDEDRDIVARTGEAAPGTWRLRKTLGEALWAEMQARPDQLDAIAHVLSFFEATAKIRSELDRLGLPAAVIEALDRGLEDGAFAKFKGAGHISAKACRNLLPHLQQGHRYDQACRLAGYDHAASTLSHTAQVVSKAGFNALVTELGESIANPIARKALTEGLKQIRAMCARWGLPGAIHIELAREVGNSIEKRRELESQRETTTKRRQTERDEIRGLLALEDVDDDTLLRYRLWKEQGGKCLYTGKDIHVRQLIATDNSVQVDHILPWSRFGDDSFNNKTLCLASANQRKRGQTPWEWFSLTGTPEAWEVFASRVETSKDLRGFKKRNLLLKNADEVAQRFRSRNLNDTRYAARLLAEAAKLFYPAGDRQEKDGRRRVLTRPGPLTAALRHAWGLESLKKADGKRVSDDRHHALDALAVAAISEREVQRLTRSFQEWEQQGLARPLRHVAPPWPGFRGDVLAAYAQAFVARPERRRARGKGHDASIRQVVGEGPEAQVFERRGLADLKEADLDRVKDPERNQAIIEAVRAWILAGRPADAPPRSPRGDVIVKLRTAPAKKIKPAVPVRGGTADRGDMVRIDVFTRPNRKGRDEWYLVPIYPHQVMNRKAWPHPPMRSVVAYKDEAGWTEIGAEHSFRFSLYPRSYVQLVKSNGDVIEGYLVSMDRSTGAFRVFVHNNPAEMAKGIGAKTLLNLRKFNVDRFGVRTEVKSEVRTWHGEVCTSPVPPD

SEQ ID NO: 795 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSELQHIGGSKYSGVAKIGNKISSLDNCILIYQSITGIFEKRIDLLKV

SEQ ID NO: 796 - protein, 769 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKCCGRL

SEQ ID NO: 797 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 798 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGAFSNISKYGGYNKVSAAYYTLIEYEEKGNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNPDNCILIYQSITGIFEKRIDLLKV

SEQ ID NO: 799 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMELDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSAYVGVCKITHKKLVIKNSASQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 800 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKFNRLTRATPISDDETAKFIARQLVETRQATKVAARVLEKMFPETKIVYSKAETVSMFRNKFDIVKCREINDFHHAHDAYLNIVVGNVYNTKFTNNLWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 801 - protein, 357 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQAFFEYLREDMEVDIDADSQKIKEILKDSSLKNSEKQSRLNKILGLKSSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKITTITPDM

SEQ ID NO: 802 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPNDYKKVFGYNKNEKNNNNYSAYVGVCKTKSKKLVINNTVNQEDFYKFLKPILLAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKNSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDSLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 803 - protein, 631 aa, Treponema denticola
MLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLRSEIQSKQRGFWNFLQRNNFISLEKLNRLTRTTPISDDETAKFIARQLVETRQATKVAAKVLEKMFPETKIVYSKAETVSMFRNKFDIVKCREINDFHHAHDAYLNIVVGNIYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKENKIRSLETIPLYLVKDIQKSQEKLKSYLTDLLGKKEIKILVPKIKINSLLKINGFPCHITGKTNDSFLLRPAVQFCCSNDEVLYFKKIIRFNEIRSQREKMGKTISPYEDLSFRSYIKENLCKKTKNDEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 804 - protein, 631 aa, Treponema denticola
MLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 805 - protein, 370 aa, Treponema denticola
MTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEDIIRWAAIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKCCGRL

SEQ ID NO: 806 - protein, 591 aa, Treponema phagedenis
MARGKEAEKGRTSSRYASIKALYENCKQDLADYDAVLEQFKSEEPLRLRSDKLYLYYTQLGRCMYTGRVIDIDRLMSDNSAYDIDHIYPRSKIKDDSLTNRVLVVKDANQDKRDEPLSPQIQDKQKGFWDFLKHNNFISIEKYERLTYRGYFTEEMLSGFIARQLVETRQGTKTAGQILEQLYPDSTVVYCKAANTSEFRQKFNLIKCREINDLHHAHDAYLNIAVGNVYYTKFTSNPRNFMKLKEPYNLRELFDRDVERNNTIAWVKNKTITTIKDMLKRNTPLYTRYAYCKTGGFFDQNIMKKGKGQFPLKENSPLSDISKYGGYNKVSGAYFILVQKKEKDAVVRILETVPLYLLNKPGKESENVREYLSTALGTKDFKILIPKIKINSLFKINGFLVHITGKTNDRFLVRSAVQFFCDDNLTLFFKRIIAFNGLRNLNKDKSMTAYDDNTMRVYVRGNLFKDKNQLFDKNKFNEIVKGKNISVYKDMVKRYETSIYKFRPNTAVIPILKSGEDKFINLPIEEQFKILQEILKLFGAINGTANLTLIGGRPSTGEMKISNNISNLKQCILIHQSPTGVFEQQIDLLKI

SEQ ID NO: 807 - protein, 1062 aa, Unknown
  Treponema sp. JC4
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEKIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 808 - protein, 281 aa, Treponema vincentii
MKTLGLDIGTNSIGWGIVDETANKIEDCGVYIFPEGVKKEKGNESSKAAERTSFRLARRLKFRRKLRKCETLKVLIKNKMCPLTMEELEKWRKQKIYPVSQDFLNWYRTDELKNWEPYFLRKKCAEQKAGPYEIGRALYHLAQRRGFLSNRKESTKASDGKVSKSIDELSSLMDGRTLGQYFYELKQSGEKVRGKYTSRKEHYEKEFNKICEVQEISPELKDDLYRAIFFQRKLKSQKFLVGKCTFERNKPRAPISHFEFEEFRMLSFINSIKIAKKLRRR

SEQ ID NO: 809 - protein, 675 aa, Unknown
  uncultured bacterium T3_7_42578
MTAENYSNVRFAFDIGTNSIGWAVFQLNDKQEATSILNAGARIFSDGRDPKTFEPLAVRRRNVRSASRMRDRYLRRRKRTLDKLIGYGLLPEDKAERDKILLETNDKPSGSTDKKTDPYSLRARALEEKLPLAYVARALFHIGQRRGFKSNRKADRKSNEKGKIAAGIEELSGLMHQSHAPTLGAYLAKRREEGHVVRLRASSEALTNKAYAFYPERAMLEDEFHKIWQAQAEYYPDVLTKEREEELFHVMFFQRPLKEQKVGLCTLVEGELRLPKSDPLFQQFRLYKEINELAIILPDLSQRKLTMEERDTLITLMRPAKTKTFAALRKALKIPAGGRFNKETENRKQLTGDEVYSVFSKPELFGGDWAKFSIEQQREIIDQLNNEENPDKLEEWLKNKFPKLSDEQRSEIINANLPDGYGRFGITATSKILEQLKKDVISEAEAAHRCGFDHSLANRNWKGLDELPRYQEVLERHIVPGTGDKNDIYDIYKGRLTNPTVHIGLNQVRRLTNRLIKAYGKPWQIVVELARDLPMSSEERKEHNKTLNDNIKAGFERTQKLERLGQKDNANNRLLLKLWEELGKDPDDRKSIYSGTRITEPMLFSGEVEIDHILPFSLTYDDSYANKILCLREENRIKRNRAPADVTEWKDRYDEIIGRSKNCQRTNKNVLGPMQ

SEQ ID NO: 810 - protein, 1017 aa, Unknown
  uncultured bacterium
MRVDSLGRCLSDEEWARVIYHLCKHRGFHWISRAEAKQTEGDSKSEGGKVKQGLAGTAKLMDEKGYRSAAEMVLAEFPEAQRNKQGEYRKALSRELLAKELALLFARQRVFGNRHATDTLETAILGNSDKKSGLFWQQKPALAGADLLKMLGTCTFEKNEYRAPKASFTAERHVWLTRLNNLRIVTDGITRQLTEQERQLVLPLPYRQAGDLTYKQLGMALTKAGLLEAGCFKFIGLAYPTEAQKAEGKTKDPESATLVKIPAWQELRQTLNKASLNDEWEKLSGDALCGQPEIFDKIAWILSVYKDDDEVRTELAKLVLPNPEGLTEALLNIRFDKFHALSLKALRAIVPHMEKGLRYDEACVQAGYHHSQLHKIGEGEHKYLPPLYDGRDGDGRMIFAEDADIPRNPVVLRSLNQARKVVNAIIRRYGSPSAVHIEMARDLSRPFDERNKIKKDQDEYQARNQRDREQFIELFGHPPKGLEFEKWRLYREQNGQCAYSQKPLASSGDVAEIFLDGSTEIDHALPYSRSFDDSKNNKVLVLTRENRDKGNRTPYEYLGGAENSERWQRFFSFVESNKAYRLAKRTRLLRKDFGAKESEEFRERNLNDTRYVCRFFKNYVEQHLKLAEGSEAKRCVVVSGQLTNFLRTRWGLLKIRSDSDRHHALDAAVVAACSHSMVQRLSNYSRTRELEQVRDGFVNIETGEIVNPAMHQQLREHFPDPWPYFRHELEARLKIDSPALLREEMARLSSYTEEELAALKPLFVSRAPQRRNGGAAHKDTIYGQPEKLKKNGSVSQKVALASLALKDIDLLADPHRNAKLYGAIRERLEAHGGKGDKAFPATNPLRKPDKEGNPTGPIVRTVTKVIDKLSGIPVRGGIAKNDTMLRVDVFTKAGRFHLVPVYVHHRVTGLPNQAITRGKDENQWAIIDDTFEWRFSLYPNDLVQIRLKDETHLGYYASTDRSTSSISIWAHDRNQSVGKDGLIRSIGVTTAKDIEKFHVDTLGNVYPAPPEKRRGLA

SEQ ID NO: 811 - protein, 600 aa, Unknown
  uncultured bacterium
VNAIIKKHGSLSAVHIEMARDLSRPLDERREVKKLQEEFKDRNDKARESFEADHGYRPKGIVFEKWMLYREQHGKCAYSMEGLDIDRVLNDANYAQIDHALPYSRSYDDSKNNKVLVLTRENQNKGNRTAYEYLTSFAGGEDGDRWRNYAAWVNSNKSYRMAKRNRLLRKNYGPDEASGFKDRNLNDTRYICKFFKNYVEEHLQLAPRADGNANKRCVVVNGQLTAFLRARWGLSKVRSESDRHHALDAAVVAACSHGMVKALADYARNKEVAYLREGFPDPETGEIINPEAHARGVHHFPEPWAHFRHELQVRLYSDDLQALREDLQRLGTYSEQDLLGVRTLFVSRAPQRRNDGAVHKETIYAQPEALRKQGGVVQKVPLTSLSLKDLDNLADPHRNAKLYTALRARLEAHGGKADKAFGPDQPFYKPDKNGNPTGPIVRTIKLVIDKLSGIPIRGGVAKNDTMLRVDVFTKAGKFHLVPVYVHHRVTGLPDRAIVAFKDEVEWTQVDDSFKFLFSIHPNDLIRIGLKAKEPMIGYFASCHRGTGAFNVWSHDRNTSVGKSGSVEGIGIKTALSLEKLNIDVLGNVYPARPEQRHGLA

SEQ ID NO: 812 - protein, 1011 aa, Unknown
  uncultured delta proteobacterium HF0070_07E19
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 813 - protein, 1011 aa, Unknown; identical to SEQ ID NO: 812
  uncultured delta proteobacterium HF0070_07E19

SEQ ID NO: 814 - protein, 1120 aa, Unknown
  Veillonella sp. oral taxon 780 str. F0422
MGFKANLVNLFTDEDIEVILPEEKEFKSINLHEGIYEDVRDAYEDAWGDRFAIVDQCKVLHDIIVISSIIKPGQSLSEAKIESYNQHKEDLVLLKSVLKEDRKLYDDMFVVDTDKGTNYVKYTKQGVNGNTSATQEEFYKYVRKVVSVLPETEHTRRIVQKLEEGTFLPLQRISKNGVVPYQLHKEELVRILDKATVNFPFLNKVENGLTVADKIISILEFKIPYYVGPLNPTHSIENGGFAWVVRKEAGQVLPWNFEQKVDVQASAVKFIENLTNKCTYLIDQDVLPKYSLLYAEFSLLNELNNIRVNDKPLPADVKQAFIRDHFISLQDSKTATKKVVAKYLVDNNYVSQPPIITGMDQQIATKLTSHRDMTRILGEHFDHAMAEDIIRYITIFGESKDMLRQVLKNYYGDRLTTEQIKKLGKLTYTGWGRLSKKFLSDIWGMKKNDDDAEAGTIIEHMREGQENLMQLLSSSYSFIDVVQEYVTNVLGEKEKTAFEMLEDLSLSPMVKRSVWQTLRILDEIVSIRKELPKKIFVEVARTNKADKKRTQSRKALLEELYKQIKDEDVHVLQQELESKEDSALNSKKLYLYFTQMGRCMYSGRRIDIHELFTDKYDIDHIYPRSLTKDDSWHNIVLVEKQLNAEKTDRFPILSAIQSKQKGFWKLLWDRGFISEKKYDRLVRTTDLTDEELNQFINRQMVSTNQSVKAVTTLLHQLYPETEVVFSKAENVSDFRHDYDFVKVRSINHHHHAKDAYLNIVVGNVYHEKFTKNFLSFAKQKGTRRTYNLTKIFEYEIKLTEESKKVIWDPNIHMDIVKKMMKSNDVRVTQRAVPQKGGLSDETIYKKGIAKRGVYLPLKSSDERVRDVEKYGGRTSITISEYIILNIRDTSDQDRIEIFSLPLYIAGKKDIHKAIEEAYLSTCKKPASVVDIQILYRGLYIGSKVNINGFTYYMGGKTGSNVSIDSAVDVVMDITSSVYIKLLEKVAIKKIENPKTFRIENIKTSYNHKEVTVSKEQNIALYQELLKKLDTPLFSKMKGNKLEEFRTVGFDTFIALSLEEQASVLLEVLNVLTNFKTKRDITKIGMTSSRSTLGINISNTEQFSVITTSITGLYEQEIKIK

SEQ ID NO: 815 - protein, 983 aa, Verminephrobacter aporrectodeae
MRRRRDRLLKRKARMHDQLMRHGFFPADAAGRKVLERLNPYQLRAKGLHQALTPGEFARALFHINQRRGFQSNRKTDRKDNESGALKQAISELRAQIHDSGCATVGEWFWKERMQQKPEGVHRQGVRARYRETPYTTDEGRQRIDKRYDLYVDRAMIEQEFDALWAVQAALQPGLFTDAACKELRYTLLFQRKLRPVKPGRCTLLPEEERAPLALPSTQRFRILQEVNHLRLLDEALREVPLTLAQRDALVAALESQGKLGFAPMRKLLKLPGTVKFNLEDEKRTELKGNATSAILARKDLFGPAWAGFDAALQDEIVWQLVSEEGEGRLIAWLQQHTGVDEARAEAIADTSLPEGYGSLSRKALERIVPALQREVCSYDKAVQAAGFAHHSDLGFDFEHSGDEVQQVGERIIASTGEVRPLFAFKQLPYYGKALQRHVAFGSGKPEDPEEKRHGKIANPTVHIGLNQVRTVVNALIRRYGRPSEVVVELARDLKQSREQQQETQRKQAENQRRNTRIRERIAETLGISPERVRSSDIQKWILWEELSFDVVDRRCPYSGEQISTTMLLSPKVEIEHILPFSQTLDDSLNNRTVALREANRIKRNRTPWDARADFEARGWSYEGILHRAERMPLRKRYRFAPDGYQRWLGEDKDFLARALNDTRYLSRVAANYLRLVCPKPQGVRVIPGRMTAMLRAKFGLNDVLGLDGEKNRNDHRHHAVDACVIGVTDQGLMQRFARASAQAREDGLTRLVQDMPLPWPSYRDHVERAVRHIWVSHKPDHGFEGAMMEETAYGIRKDGSIKPRRKADGSAGREVVNLIRITESRQPVRHGVDSQGQPLPYKGYVGGSNYCIEITANDQGKWEGAVISTFEAYRIVRASGWGRLRHCSHGQNGRPLMMRLMIGDAVRLALDGSEKTMRVVKISANGQVFLVAPNEANVDARNRDKADPFAYVSKKAGSFQSAKARQVSISPIGELRDPGFKG

SEQ ID NO: 816 - RNA, 94 nt, Artificial Sequence
  Synthetic nucleic acid sequence
guuuucccuuuucaaagaaaucuccugggcaccuaucuucuuaggugcccucccuuguuuaaaccugaccaguuaaccggcugguuagguuuuu

SEQ ID NO: 817 - RNA, 22 nt, Artificial Sequence
  Synthetic nucleic acid sequence
gagauuuaugaaaagggaaaac

SEQ ID NO: 818 - RNA, 36 nt, Artificial Sequence
  Synthetic nucleic acid sequence
uaaucccacagccgccaguuccgcuggcggcauuuu

SEQ ID NO: 819 - RNA, 10 nt, Artificial Sequence
  Synthetic nucleic acid sequence
aagccaaaaa

SEQ ID NO: 820 - DNA, 15 bp, Artificial Sequence
  Synthetic nucleic acid sequence
tcttcattgcgctta

SEQ ID NO: 821 - RNA, 73 nt, Artificial Sequence
  Synthetic nucleic acid sequence
aacagcauagcaaguuaaaauaaggcuaguccguuaucaacuugaaaaguggcaccgagucggugcuuuuuuu

SEQ ID NO: 822 - DNA, 20 bp, Artificial Sequence
  Synthetic nucleic acid sequence
gcagcagaagaagcctttgt

SEQ ID NO: 823 - DNA, 20 bp, Artificial Sequence
  Synthetic nucleic acid sequence
ttcctcctctccctcctctc

SEQ ID NO: 824 - RNA, 125 nt, Artificial Sequence
  Synthetic nucleic acid sequence
  misc_feature (13)..(112): n at each of these positions can be present or absent such that this region can contain anywhere from 3 to 100 nucleotides. n is a, c, g, or u
guuuuagagcuannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnuagcaaguuaaaa

SEQ ID NO: 825 - RNA, 123 nt, Artificial Sequence
  Synthetic nucleic acid sequence
  misc_feature (12)..(111): n at each of these positions can be present or absent such that this region can contain Anywhere from 3 to 100 nucleotides. n is a, c, g, or u
guuuagagcugnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaaguuaaa

SEQ ID NO: 826 - RNA, 124 nt, Artificial Sequence
  Synthetic nucleic acid sequence
  misc_feature (13)..(112): n at each of these positions can be present or absent such that this region can contain Anywhere from 3 to 100 nucleotides. n is a, c, g, or u
guuuuagagcugnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgaguuaaa

SEQ ID NO: 827 - RNA, 128 nt, Artificial Sequence
  Synthetic nucleic acid sequence
  misc_feature (14)..(113): n at each of these positions can be present or absent such that this region can contain anywhere from 3 to 100 nucleotides. n is a, c, g, or u
guuuuuguacucunnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagcuacaaagau

SEQ ID NO: 828 - RNA, 122 nt, Artificial Sequence
  Synthetic nucleic acid sequence
  misc_feature (12)..(111): n at each of these positions can be present or absent such that this region can contain anywhere from 3 to 100 nucleotides. n is a, c, g, or u
guuguagcuccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnguugcuacaau

SEQ ID NO: 829 - RNA, 42 nt, Artificial Sequence
  Synthetic nucleic acid sequence
guuuuagagcuagaaauagcaaguuaaaauaaggcuaguccg

SEQ ID NO: 830 - protein, 7 aa, Simian virus 40
PKKKRKV

SEQ ID NO: 831 - protein, 16 aa, Unknown
  /note="Description of Unknown: Nucleoplasmin bipartite NLS sequence"
KRPAATKKAGQAKKKK

SEQ ID NO: 832 - protein, 9 aa, Unknown
  /note="Description of Unknown:  -myc NLS sequence"
PAAKRVKLD

SEQ ID NO: 833 - protein, 11 aa, Unknown
  /note="Description of Unknown:  C-myc NLS sequence"
RQRRNELKRSP

SEQ ID NO: 834 - protein, 38 aa, Homo sapiens
NQSSNFGPMKGGNFGGRSSGPYGGGGQYFAKPRNQGGY

SEQ ID NO: 835 - protein, 42 aa, Unknown
  /note="Description of Unknown: IBB domain from importin-alpha sequence"
  misc_feature (5)..(5): Xaa can be any naturally occurring amino acid
RMRIXFKNKGKDTAELRRRRVEVSVELRKAKKDEQILKRRNV

SEQ ID NO: 836 - protein, 8 aa, Unknown
  /note="Description of Unknown:  Myoma T protein sequence"
VSRKRPRP

SEQ ID NO: 837 - protein, 8 aa, Unknown
  /note="Description of Unknown: Myoma T protein sequence"
PPKKARED

SEQ ID NO: 838 - protein, 8 aa, Homo sapiens
PQPKKKPL

SEQ ID NO: 839 - protein, 12 aa, Mus musculus
SALIKKKKKMAP

SEQ ID NO: 840 - protein, 5 aa, Influenza virus
DRLRR

SEQ ID NO: 841 - protein, 7 aa, Influenza virus
PKQKKRK

SEQ ID NO: 842 - protein, 10 aa, Hepatitus delta virus
RKLKKKIKKL

SEQ ID NO: 843 - protein, 10 aa, Mus musculus
REKKKFLKRR

SEQ ID NO: 844 - protein, 20 aa, Homo sapiens
KRKGDEVDGVDEVAKKKSKK

SEQ ID NO: 845 - protein, 17 aa, Homo sapiens
RKCLQAGMNLEARKTKK

SEQ ID NO: 846 - protein, 1423 aa, Artificial Sequence
  /note="Description of Artificial Sequence: Synthetic polypeptide"
MDYKDHDGDYKDHDIDYKDDDDKMAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 847 - DNA, 4677 bp, Artificial Sequence
  /note="Description of Artificial Sequence: Synthetic polynucleotide"
tctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacatgtacccatacgatgttccagattacgcttcgccgaagaaaaagcgcaaggtcgaagcgtccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtggaggccagctaaggatccggcaagactggccccgcttggcaacgcaacagtgagcccctccctagtgtgtttggggatgtgactatgtattcgtgtgttggccaacgggtcaacccgaacagattgatacccgccttggcatttcctgtcagaatgtaacgtcagttgatggtact

What is claimed is:

1. A compound selected from the group consisting of:

benzyl (4-((2-((1-(1-(((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)ethyl)amino)-4-oxobutyl)carbamate, benzyl (4-((1,3-bis((1-(1-(((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)propan-2-yl)amino)-4-oxobutyl)carbamate, benzyl (4-((1,3-bis((1-(1-(((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)-2-(((1-(1-(((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)methyl)propan-2-yl)amino)-4-oxobutyl)carbamate, N-(2-((1-(1-(((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)ethyl)-4-aminobutanamide, 4-amino-N-{1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]propan-2-yl}butanamide, 4-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)butanamide, 4-amino-N-[1,31-bis(1-{[(1S,2R,3R,4R,5S)-4-(acetylamino)-2,3-dihydroxy-6,8-dioxabicyclo[3.2.1]oct-1-yl]methyl}-1H-1,2,3-triazol-4-yl)-2,6,10,14,18,22,26,30-octaoxahentriacontan-16-yl]butanamide, 4-amino-N-{1,31-bis(1-{[(1S,2R,3R,4R,5S)-4-(acetylamino)-2,3-dihydroxy-6,8-dioxabicyclo[3.2.1]oct-1- yl]methyl}-1H-1,2,3-triazol-4-yl)-16-[15-(1-{[(1S,2R, 3R,4R,5S)-4-(acetylamino)-2,3-dihydroxy-6,8-dioxabicyclo[3.2.1]oct-1-yl]methyl}-1H-1,2,3-triazol-4-yl)-2,6,10,14-tetraoxapentadec-1-yl]-2,6,10,14,18, 22,26,30-octaoxahentriacontan-16-yl}butanamide, N-{(1S,2R,3R,4R,5S)-1-[(hexyloxy)methyl]-2,3-dihydroxy-6,8-dioxabicyclo[3.2.1]oct-4-yl}acetamide, N-[(1S,2R,3R,4R,5S)-2,3-dihydroxy-1-(2,5,8,11,14-pentaoxapentadec-1-yl)-6,8-dioxabicyclo[3.2.1]oct-4-yl] acetamide, N-((1S,2R,3R,4R,5S)-2,3-dihydroxy-1-(hydroxymethyl)-6,8-dioxabicyclo[3.2.1]octan-4-yl)-2,2,2-trifluoroacetamide, compound, N-[(1S,2R,3R,4R,5S)-2,3-dihydroxy-1-(hydroxymethyl)-6,8-dioxabicyclo[3.2.1]oct-4-yl]-2,2,2-trifluoroacetamide, N-[(1S,2R,3R,4R,5S)-2,3-dihydroxy-1-(hydroxymethyl)-6,8-dioxabicyclo[3.2.1]oct-4-yl]propanamide, N-[(1S,2R,3R,4R,5S)-2,3-dihydroxy-1-(hydroxymethyl)-6,8-dioxabicyclo[3.2.1]oct-4-yl]methanesulfonamide, N-[(1 S,2R,3R,4R,5S)-2,3-dihydroxy-1-(hydroxymethyl)-6,8-dioxabicyclo[3.2.1]oct-4-yl]-2,2-difluoroacetamide, N-[(1S,2R,3R,4R,5S)-2,3-dihydroxy-1-(hydroxymethyl)-6,8-dioxabicyclo[3.2.1]oct-4-yl]-3,3,3-trifluoropropanamide, N-[(1S,2R,3R,4R,5S)-2,3-dihydroxy-1-(hydroxymethyl)-6,8-dioxabicyclo[3.2.1]oct-4-yl]-N-methylacetamide, N-[(1S,2R,3R,4R,5S)-2,3-dihydroxy-1-(hydroxymethyl)-6,8-dioxabicyclo[3.2.1]oct-4-yl]-N-methylmethanesulfonamide, tert-butyl [(1S,2R,3R,4R,5S)-2,3-dihydroxy-1-(hydroxymethyl)-6,8-dioxabicyclo[3.2.1]oct-4-yl]methylcarbamate, (1S,2R,3R,4R,5S)-1-(hydroxymethyl)-4-(methylamino)-6,8-dioxabicyclo[3.2.1]octane-2,3-diol hydrochloride, N-[(1S,2R,3R,4R,5S)-2,3-dihydroxy-1-(15-phenyl-2,5,8, 11,14-pentaoxapentadec-1-yl)-6,8-dioxabicyclo[3.2.1] oct-4-yl]acetamide, N-[(1S,2R,3R,4R,5S)-1-(13-azido-2,5,8,11-tetraoxatridec-1-yl)-2,3-dihydroxy-6,8-dioxabicyclo[3.2.1] oct-4-yl]acetamide, N-[(1S,2R,3R,4R,5S)-2,3-dihydroxy-1-(2,5,8,11-tetraoxatetradec-13-en-1-yl)-6,8-dioxabicyclo[3.2.1]oct-4-yl] acetamide, N-[(1S,2R,3R,4R,5S)-2,3-dihydroxy-1-(2,5,8,11-tetraoxatetradec-13-yn-1-yl)-6,8-dioxabicyclo[3.2.1]oct-4-yl] acetamide, N-[(1S,2R,3R,4R,5S)-1-(13-amino-2,5,8,11-tetraoxatridec-1-yl)-2,3-dihydroxy-6,8-dioxabicyclo[3.2.1] oct-4-yl]acetamide, N-[(1S,2R,3R,4R,5S)-2,3-dihydroxy-1-(13-hydroxy-2,5, 8,11-tetraoxatridec-1-yl)-6,8-dioxabicyclo[3.2.1]oct-4-yl]acetamide, 1-[(1S,2R,3R,4R,5S)-4-(acetylamino)-2,3-dihydroxy-6, 8-dioxabicyclo[3.2.1]oct-1-yl]-2,5,8,11-tetraoxatridecan-13-oic acid, S-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}ethanethioate, N-{(1S,2R,3R,4R,5S)-2,3-dihydroxy-1-[13-(pyridin-2-yldisulfanyl)-2,5,8,11-tetraoxatridec-1-yl]-6,8-dioxabicyclo[3.2.1]oct-4-yl}acetamide, N-(1,3-bis[(1-{1-[(1S,2R,3R,4R,5S)-4-(acetylamino)-2, 3-dihydroxy-6,8-dioxabicyclo[3.2.1]oct-1-yl]-2,5,8, 11-tetraoxatridecan-13-yl}-1H-1,2,3-triazol-4-yl) methoxy]-2-{[(1-{1-[(1S,2R,3R,4R,5S)-4-(acetylamino)-2,3-dihydroxy-6,8-dioxabicyclo[3.2.1] oct-1-yl]-2,5,8,11-tetraoxatridecan-13-yl}-1H-1,2,3-triazol-4-yl)methoxy]methyl}propan-2-yl)-6-(pyridin-2-yldisulfanyl)hexanamide, N-[(1S,2R,3R,4R,5S)-1-(13-{4-[(3-[(1-{1-[(1S,2R,3R, 4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R, 4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl) methoxy]methyl}-2-aminopropoxy)methyl]-1H-1,2,3-triazol-1-yl}-2,5,8,11-tetraoxatridec-1-yl)-2,3-dihydroxy-6,8-dioxabicyclo[3.2.1]oct-4-yl]acetamide hydrochloric acid salt, 6-azido-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1] oct-1-yl]-2,5,8,11-tetraoxatridecan-13-yl}-1H-1,2,3-triazol-4-yl)methoxy]methyl}propan-2-yl) hexanamide, N-(1,3-bis[(1-{1-[(1S,2R,3R,4R,5S)-4-(acetylamino)-2, 3-dihydroxy-6,8-dioxabicyclo[3.2.1]oct-1-yl]-2,5,8, 11-tetraoxatridecan-13-yl}-1H-1,2,3-triazol-4-yl) methoxy]-2-{[(1-{1-[(1S,2R,3R,4R,5S)-4-(acetylamino)-2,3-dihydroxy-6,8-dioxabicyclo[3.2.1] oct-1-yl]-2,5,8,11-tetraoxatridecan-13-yl}-1H-1,2,3-triazol-4-yl)methoxy]methyl}propan-2-yl)hept-6-enamide, N-(1,3-bis[(1-{1-[(1S,2R,3R,4R,5S)-4-(acetylamino)-2, 3-dihydroxy-6,8-dioxabicyclo[3.2.1]oct-1-yl]-2,5,8, 11-tetraoxatridecan-13-yl}-1H-1,2,3-triazol-4-yl) methoxy]-2-{[(1-{1-[(1S,2R,3R,4R,5S)-4-(acetylamino)-2,3-dihydroxy-6,8-dioxabicyclo[3.2.1] oct-1-yl]-2,5,8,11-tetraoxatridecan-13-yl}-1H-1,2,3-triazol-4-yl)methoxy]methyl}propan-2-yl)hept-6-ynamide, 7-[(1,3-bis[(1-{1-[(1S,2R,3R,4R,5S)-4-(acetylamino)-2, 3-dihydroxy-6,8-dioxabicyclo[3.2.1]oct-1-yl]-2,5,8, 11-tetraoxatridecan-13-yl}-1H-1,2,3-triazol-4-yl) methoxy]-2-{[(1-{1-[(1S,2R,3R,4R,5S)-4-(acetylamino)-2,3-dihydroxy-6,8-dioxabicyclo[3.2.1] oct-1-yl]-2,5,8,11-tetraoxatridecan-13-yl}-1H-1,2,3-triazol-4-yl)methoxy]methyl}propan-2-yl)amino]-7-oxoheptanoic acid (Sodium salt), benzyl {6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1] oct-1-yl]-2,5,8,11-tetraoxatridecan-13-yl}-1H-1,2,3-triazol-4-yl)methoxy]methyl}propan-2-yl)amino]-6-oxohexyl}carbamate, 6-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1] oct-1-yl]-2,5,8,11-tetraoxatridecan-13-yl}-1H-1,2,3-triazol-4-yl)methoxy]methyl}propan-2-yl)hexanamide acetate salt, N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-

(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)amino]-6-
oxohexyl}-6-(2,5-dioxo-2,5-dihydro-1H-pyrrol-1-yl)
hexanamide,
N-{6-[(1,3-bis[(1-{1-[(1S,2R,3R,4R,5S)-4-(acety-
lamino)-2,3-dihydroxy-6,8-dioxabicyclo[3.2.1]oct-1-
yl]-2,5,8,11-tetraoxatridecan-13-yl}-1H-1,2,3-triazol-
4-yl)methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)amino]-6-
oxohexyl}-6-[(bromoacetyl)amino]hexanamide,
4-{[(2R)-5-(carbamoylamino)-2-{[(2R)-2-cyclopentyl-2-
{[6-(2,5-dioxo-2,5-dihydro-1H-pyrrol-1-yl)hexanoyl]
amino}acetyl]amino}pentanoyl]amino}benzyl {6-[(1,
3-bis[(1-{1-[(1S,2R,3R,4R,5S)-4-(acetylamino)-2,3-
dihydroxy-6,8-dioxabicyclo[3.2.1]oct-1-yl]-2,5,8,11-
tetraoxatridecan-13-yl}-1H-1,2,3-triazol-4-yl)
methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)amino]-6-
oxohexyl}carbamate,
N-(1,3-bis[(1-{1-[(1S,2R,3R,4R,5S)-4-(acetylamino)-2,
3-dihydroxy-6,8-dioxabicyclo[3.2.1]oct-1-yl]-2,5,8,
11-tetraoxatridecan-13-yl}-1H-1,2,3-triazol-4-yl)
methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)-3,19-dioxo-
1-(pyridin-2-yldisulfanyl)-7,10,13,16-tetraoxa-4,20-
diazahexacosan-26-amide,
N-(1,3-bis[(1-{1-[(1S,2R,3R,4R,5S)-4-(acetylamino)-2,
3-dihydroxy-6,8-dioxabicyclo[3.2.1]oct-1-yl]-2,5,8,
11-tetraoxatridecan-13-yl}-1H-1,2,3-triazol-4-yl)
methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)-3,31-dioxo-
1-(pyridin-2-yldisulfanyl)-7,10,13,16,19,22,25,28-
octaoxa-4,32-d iazaoctatriacontan-38-amide,
N-{6-[(1,3-bis[(1-{1-[(1S,2R,3R,4R,5S)-4-(acety-
lamino)-2,3-dihydroxy-6,8-dioxabicyclo[3.2.1]oct-1-
yl]-2,5,8,11-tetraoxatridecan-13-yl}-1H-1,2,3-triazol-
4-yl)methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)amino]-6-
oxohexyl}-6-(pyridin-2-yldisulfanyl)hexanamide,
2-(pyridin-2-yldisulfanyl)ethyl {6-[(1,3-bis[(1-{1-[(1S,
2R,3R,4R,5S)-4-(acetylamino)-2,3-dihydroxy-6,8-di-
oxabicyclo[3.2.1]oct-1-yl]-2,5,8,11-tetraoxatridecan-
13-yl}-1H-1,2,3-triazol-4-yl)methoxy]-2-{[(1-{1-[(1S,
2R,3R,4R,5S)-4-(acetylamino)-2,3-dihydroxy-6,8-
dioxabicyclo[3.2.1]oct-1-yl]-2,5,8,11-
tetraoxatridecan-13-yl}-1H-1,2,3-triazol-4-yl)
methoxy]methyl}propan-2-yl)amino]-6-
oxohexyl}carbamate,
N-{6-[(1,3-bis[(1-{1-[(1S,2R,3R,4R,5S)-4-(acety-
lamino)-2,3-dihydroxy-6,8-dioxabicyclo[3.2.1]oct-1-
yl]-2,5,8,11-tetraoxatridecan-13-yl}-1H-1,2,3-triazol-
4-yl)methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)amino]-6-
oxohexyl}-6-(4,4,5,5-tetramethyl-1,3,2-dioxaborolan-
2-yl)hexanamide,
N-{6-[(1,3-bis[(1-{1-[(1S,2R,3R,4R,5S)-4-(acety-
lamino)-2,3-dihydroxy-6,8-dioxabicyclo[3.2.1]oct-1-
yl]-2,5,8,11-tetraoxatridecan-13-yl}-1H-1,2,3-triazol-
4-yl)methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)amino]-6-
oxohexyl}-N'-(1,3-dihydroxypropan-2-yl)
heptanediamide,
6-azido-N-{6-[(1,3-bis[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)amino]-6-
oxohexyl}hexanamide,
6-(benzyloxy)-N-{6-[(1,3-bis[(1-{1-[(1S,2R,3R,4R,5S)-
4-(acetylamino)-2,3-dihydroxy-6,8-dioxabicyclo
[3.2.1]oct-1-yl]-2,5,8,11-tetraoxatridecan-13-yl}-1H-
1,2,3-triazol-4-yl)methoxy]-2-{[(1-{1-[(1S,2R,3R,4R,
5S)-4-(acetylamino)-2,3-dihydroxy-6,8-dioxabicyclo
[3.2.1]oct-1-yl]-2,5,8,11-tetraoxatridecan-13-yl}-1H-
1,2,3-triazol-4-yl)methoxy]methyl}propan-2-yl)
amino]-6-oxohexyl}hexanamide,
(1S,2R,3R,4R,5S)-4-(acetylamino)-1-{13-[4-({3-[(1-{1-
[(1S,2R,3R,4R,5S)-4-(acetylamino)-2,3-bis(acety-
loxy)-6,8-dioxabicyclo[3.2.1]oct-1-yl]-2,5,8,11-tet-
raoxatridecan-13-yl}-1H-1,2,3-triazol-4-yl)methoxy]-
2-{[(1-{1-[(1S,2R,3R,4R,5S)-4-(acetylamino)-2,3-bis
(acetyloxy)-6,8-dioxabicyclo[3.2.1]oct-1-yl]-2,5,8,11-
tetraoxatridecan-13-yl}-1H-1,2,3-triazol-4-yl)
methoxy]methyl}-2-({6[(6hydroxyhexanoyl)amino]
hexanoyl}amino)propoxy}methyl)-1H-1,2,3-triazol-1-
yl]-2,5,8,11-tetraoxatridec-1-yl}-3-(acetyloxy)-6,8-
dioxabicyclo[3.2.1]oct-2-yl acetate,
benzyl [6-({6-[(1,3-bis[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)amino]-6-
oxohexyl}amino)-6-oxohexyl]carbamate,
6-amino-N-{6-[(1,3-bis[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]-2-{[(1-{1-[(1S,2R,3R,4R,5S)-4-
(acetylamino)-2,3-dihydroxy-6,8-dioxabicyclo[3.2.1]
oct-1-yl]-2,5,8,11-tetraoxatridecan-13-yl}-1H-1,2,3-
triazol-4-yl)methoxy]methyl}propan-2-yl)amino]-6-
oxohexyl}hexanamide acetate,
4-(benzyloxy)-N-(1,3-bis[(1-{1-[(1S,2R,3R,4R,5S)-4-
amino-2,3-dihydroxy-6,8-dioxabicyclo[3.2.1]oct-1-
yl]-2,5,8,11-tetraoxatridecan-13-yl}-1H-1,2,3-triazol-
4-yl)methoxy]-2-{[(1-{1-[(1S,2R,3R,4R,5S)-4-amino-
2,3-dihydroxy-6,8-dioxabicyclo[3.2.1]oct-1-yl]-2,5,8,
11-tetraoxatridecan-13-yl}-1H-1,2,3-triazol-4-yl)
methoxy]methyl}propan-2-yl)butanamide,
N-(1,3-bis[(1-{1-[(1S,2R,3R,4R,5S)-4-(acetylamino)-2,
3-dihydroxy-6,8-dioxabicyclo[3.2.1]oct-1-yl]-2,5,8,
11-tetraoxatridecan-13-yl}-1H-1,2,3-triazol-4-yl)
methoxy]-2-{[(1-{1-[(1S,2R,3R,4R,5S)-4-
(acetylamino)-2,3-dihydroxy-6,8-dioxabicyclo[3.2.1]

oct-1-yl]-2,5,8,11-tetraoxatridecan-13-yl}-1H-1,2,3-triazol-4-yl)methoxy]methyl}propan-2-yl)-4-hydroxybutanamide, and N-(2-{[6-({6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}amino)-6-oxohexyl]oxy}-1,3-dioxan-5-yl)-6-(pyridin-2-yldisulfanyl)hexanamide or a pharmaceutically acceptable salt thereof.

2. A compound of Formula (B)

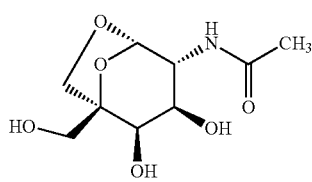 [SMILES: CC(=O)N[C@H]1[C@H]2OC[C@](CO)(O2)[C@H](O)[C@@H]1O]

(B) or a pharmaceutically acceptable salt thereof.

3. A compound of Formula (C), (D), (E), (F), (G), or (H)

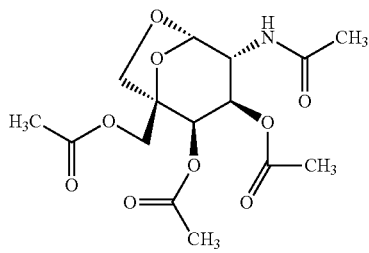
(C)

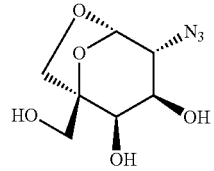
(D)

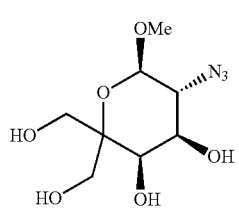
(E)

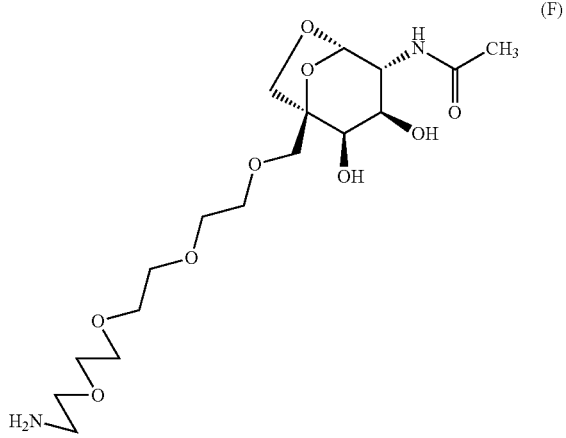
(F)

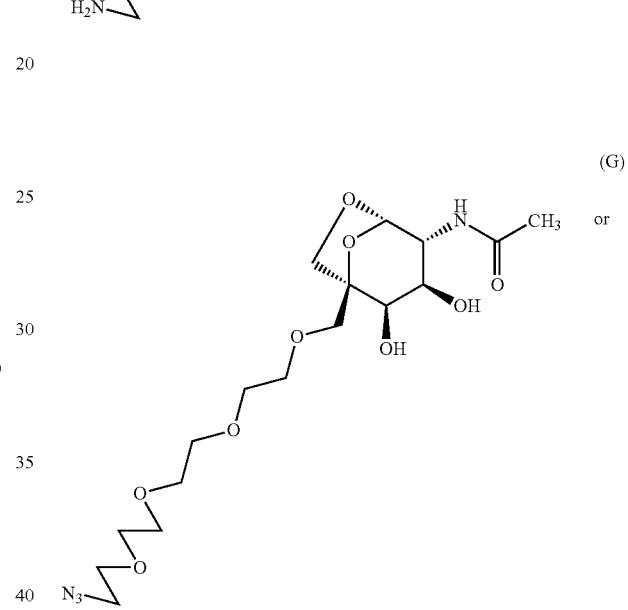
(G) or

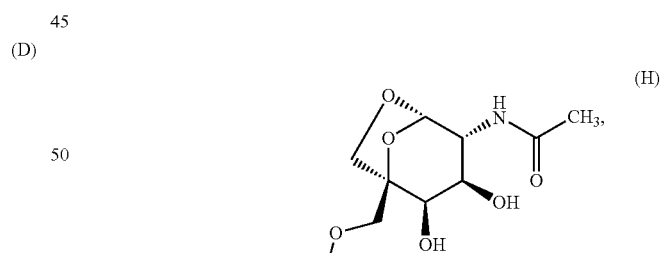
(H)

or a pharmaceutically acceptable salt thereof.

4. A compound of Formula (7)
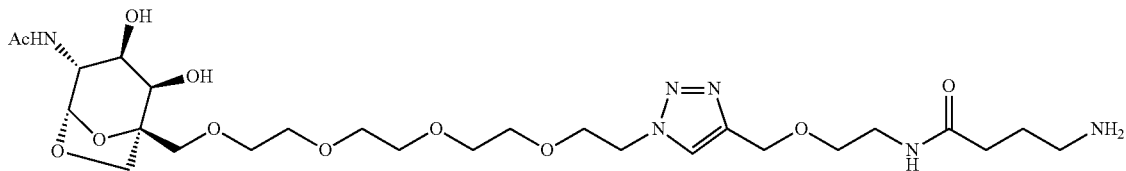 [SMILES: CC(=O)N[C@H]1[C@H]2OC[C@](COCCOCCOCCOCCn3cc(COCCNC(=O)CCCN)nn3)(O2)[C@H](O)[C@@H]1O]
(7) or a pharmaceutically acceptable salt thereof.
5. A compound of Formula (8)
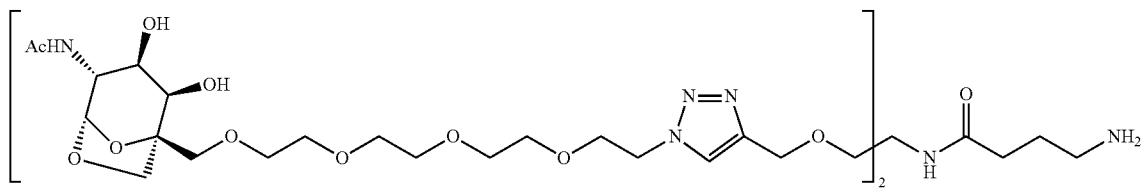
(8) or a pharmaceutically acceptable salt thereof.
6. A compound of Formula (9F)
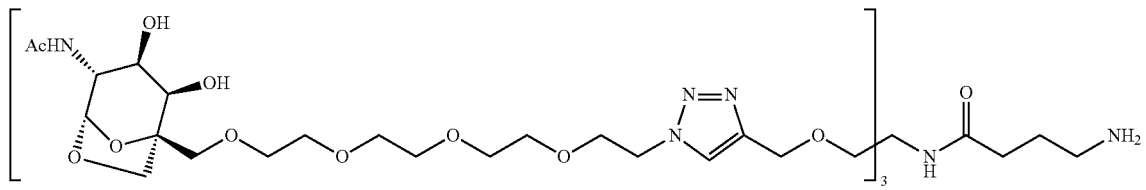
(9) or a pharmaceutically acceptable salt thereof.
7. A compound of Formula (38A)
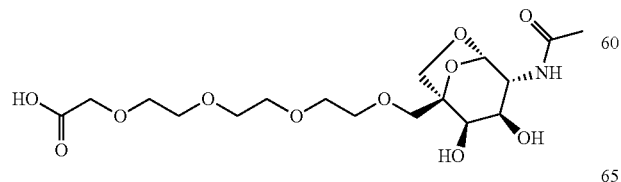
(38A) or a pharmaceutically acceptable salt thereof.

8. A compound of Formula (41)
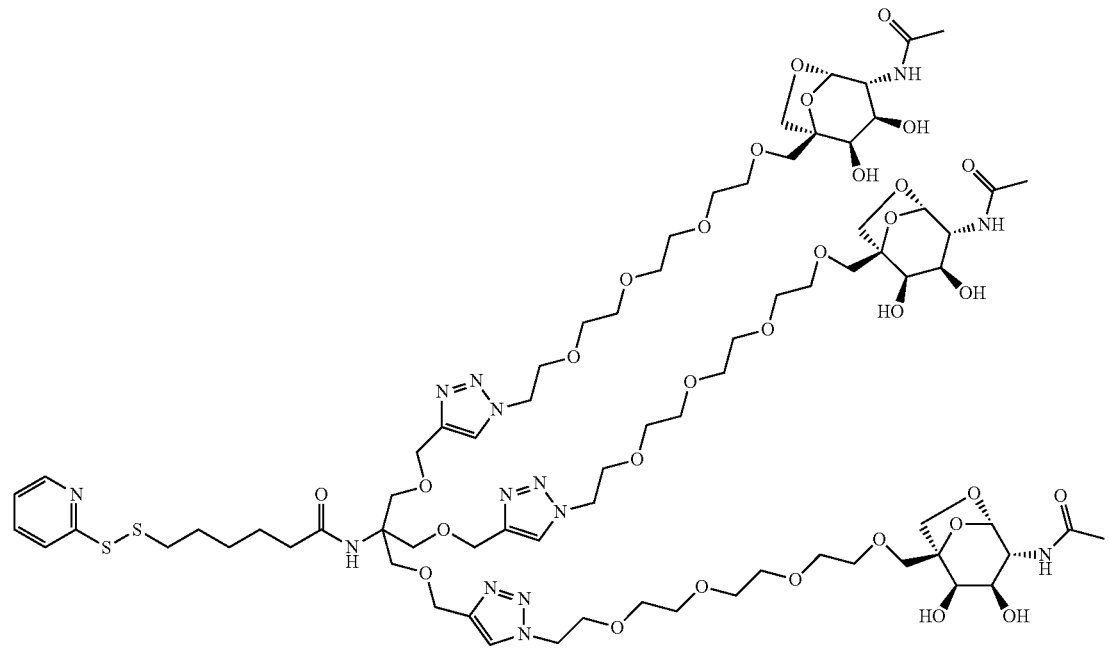 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCSSc4ccccn4)nn3)(O2)[C@H](O)[C@@H]1O]
(41) or a pharmaceutically acceptable salt thereof.
9. A compound of Formula (42)
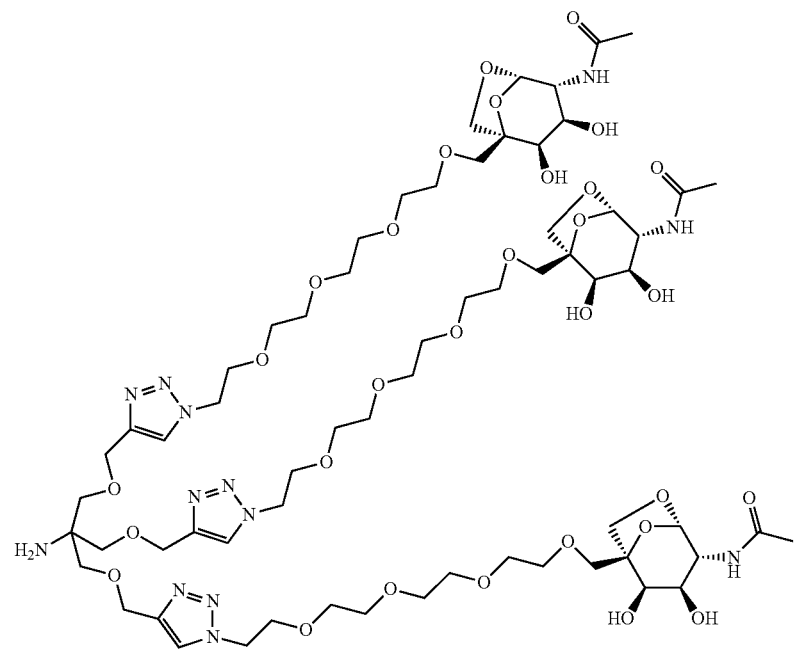 [SMILES: CC(=O)N[C@H]1[C@H]2OC[C@](COCCOCCOCCOCCn3cc(COCC(N)(COCc4cn(CCOCCOCCOCCOC[C@@]56CO[C@@H](O5)[C@H](NC(C)=O)[C@@H](O)[C@H]6O)nn4)COCc4cn(CCOCCOCCOCCOC[C@@]56CO[C@@H](O5)[C@H](NC(C)=O)[C@@H](O)[C@H]6O)nn4)nn3)(O2)[C@H](O)[C@@H]1O]
(42) or a pharmaceutically acceptable salt thereof.

10. A compound of Formula (43)
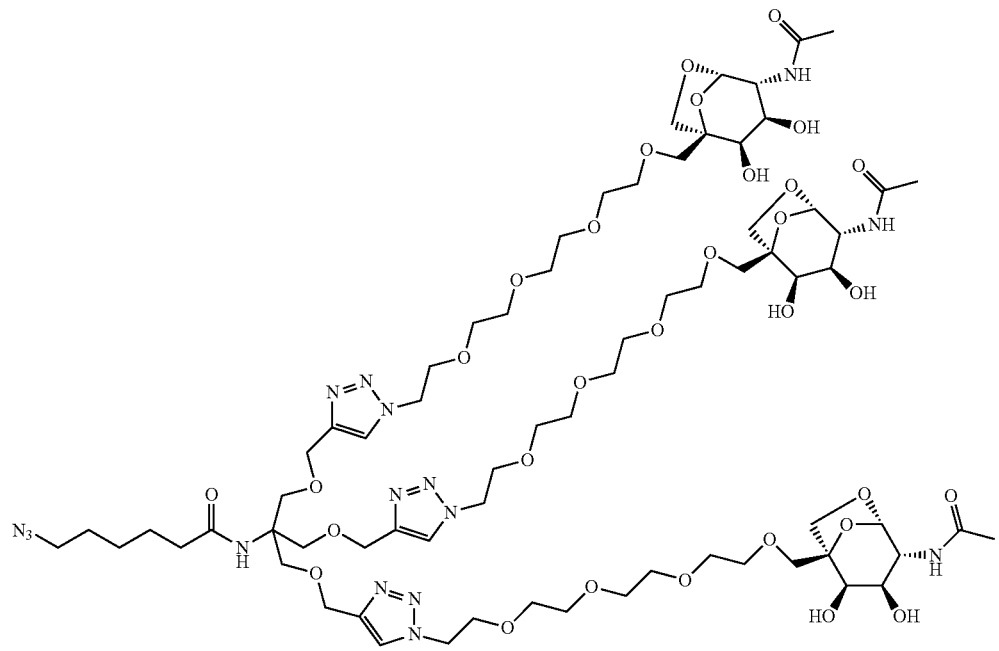 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCN=[N+]=[N-])nn3)(O2)[C@H](O)[C@@H]1O]
(43) or a pharmaceutically acceptable salt thereof.
11. A compound of Formula (46)
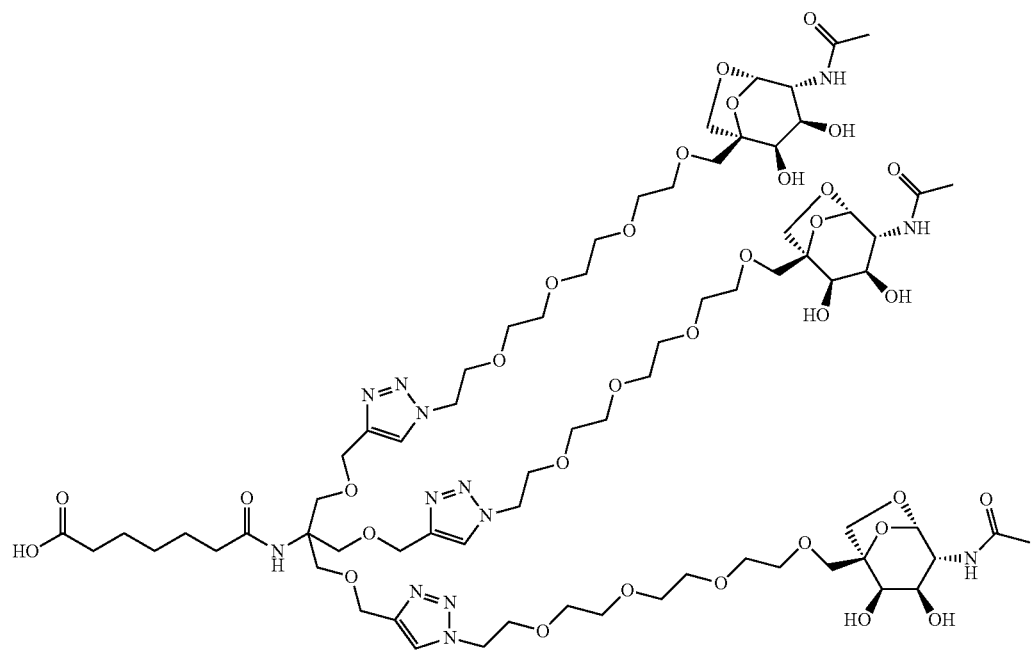 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCC(=O)O)nn3)(O2)[C@H](O)[C@@H]1O]
(46) or a pharmaceutically acceptable salt thereof.

12. A compound of Formula (48)
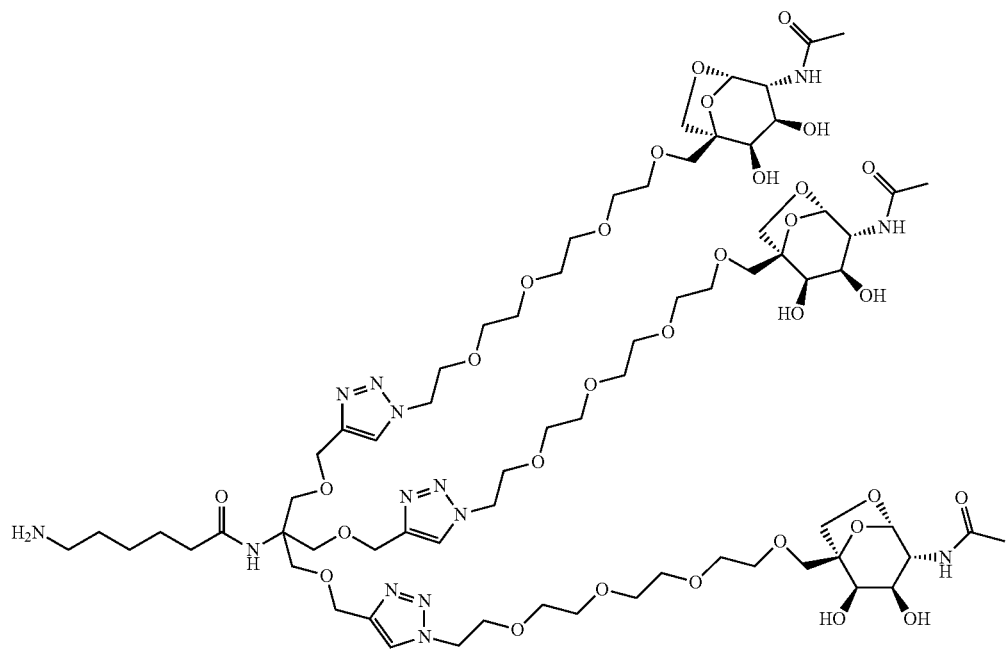 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCN)nn3)(O2)[C@H](O)[C@@H]1O]
(48) or a pharmaceutically acceptable salt thereof.
13. A compound of Formula (52)

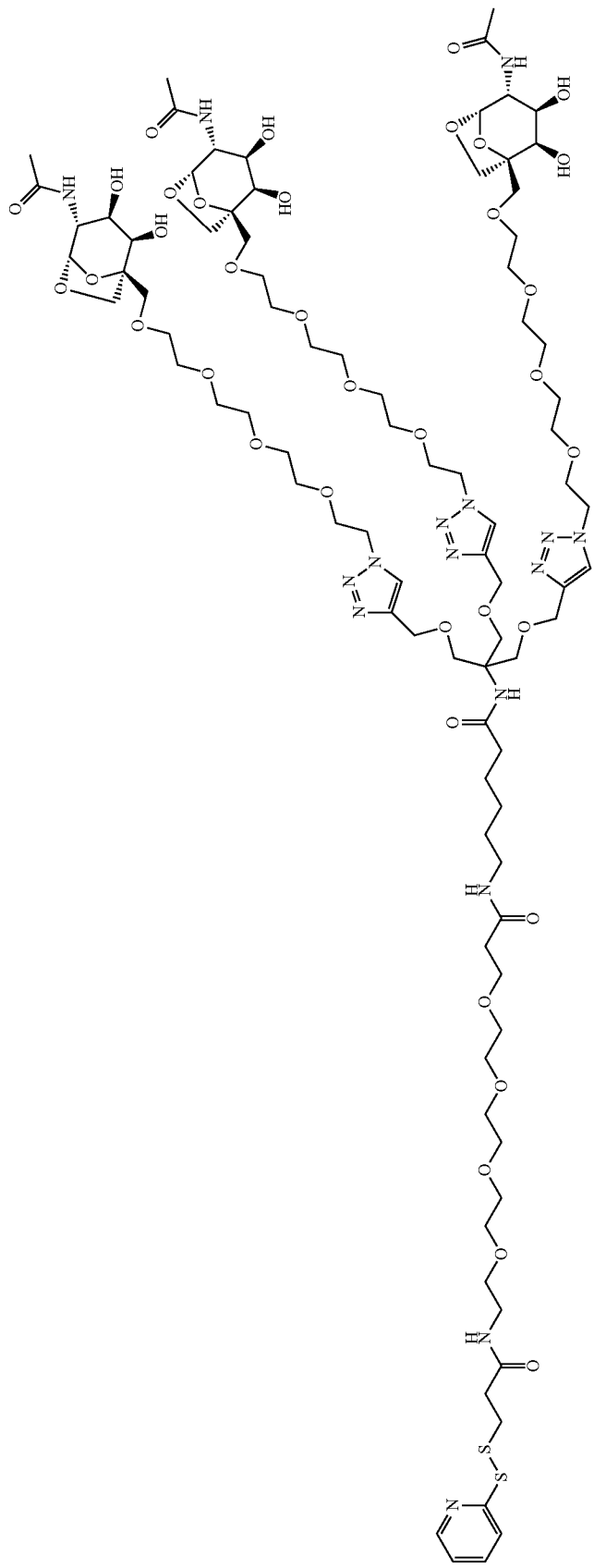

(52) or a pharmaceutically acceptable salt thereof.
14. A compound of Formula (54)
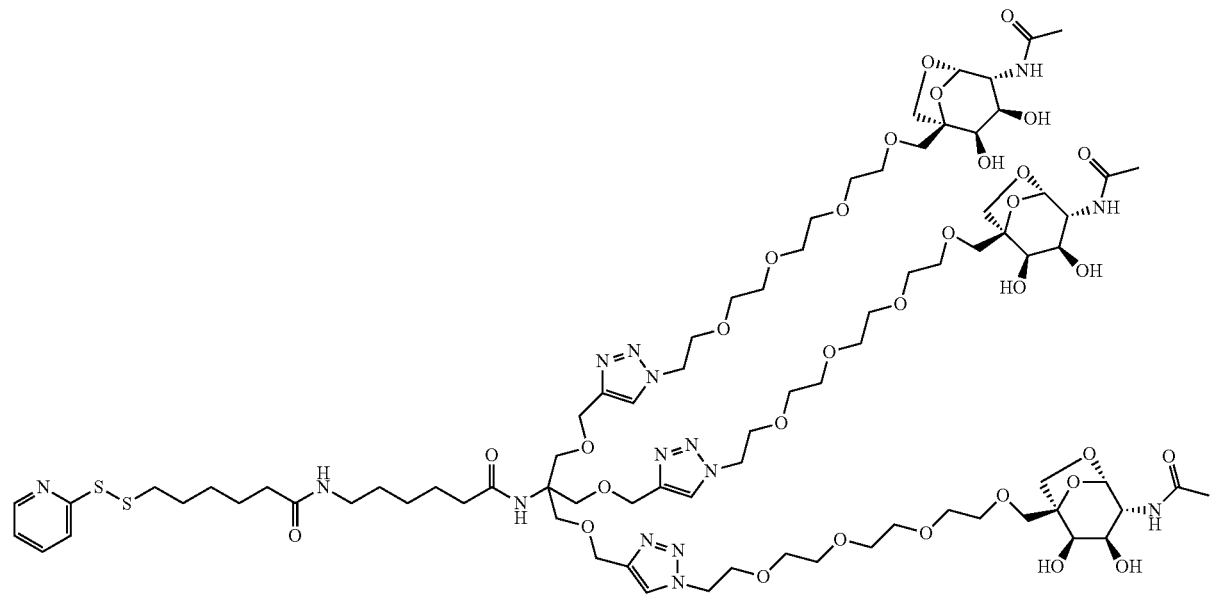 [SMILES: CC(=O)N[C@H]1[C@H]2OC[C@](COCCOCCOCCOCCn3cc(COCC(COCc4cn(CCOCCOCCOCCOC[C@@]56CO[C@@H](O5)[C@H](NC(C)=O)[C@@H](O)[C@H]6O)nn4)(COCc4cn(CCOCCOCCOCCOC[C@@]56CO[C@@H](O5)[C@H](NC(C)=O)[C@@H](O)[C@H]6O)nn4)NC(=O)CCCCCNC(=O)CCCCCSSc4ccccn4)nn3)(O2)[C@H](O)[C@@H]1O]
(54) or a pharmaceutically acceptable salt thereof.
15. A compound of Formula (66)

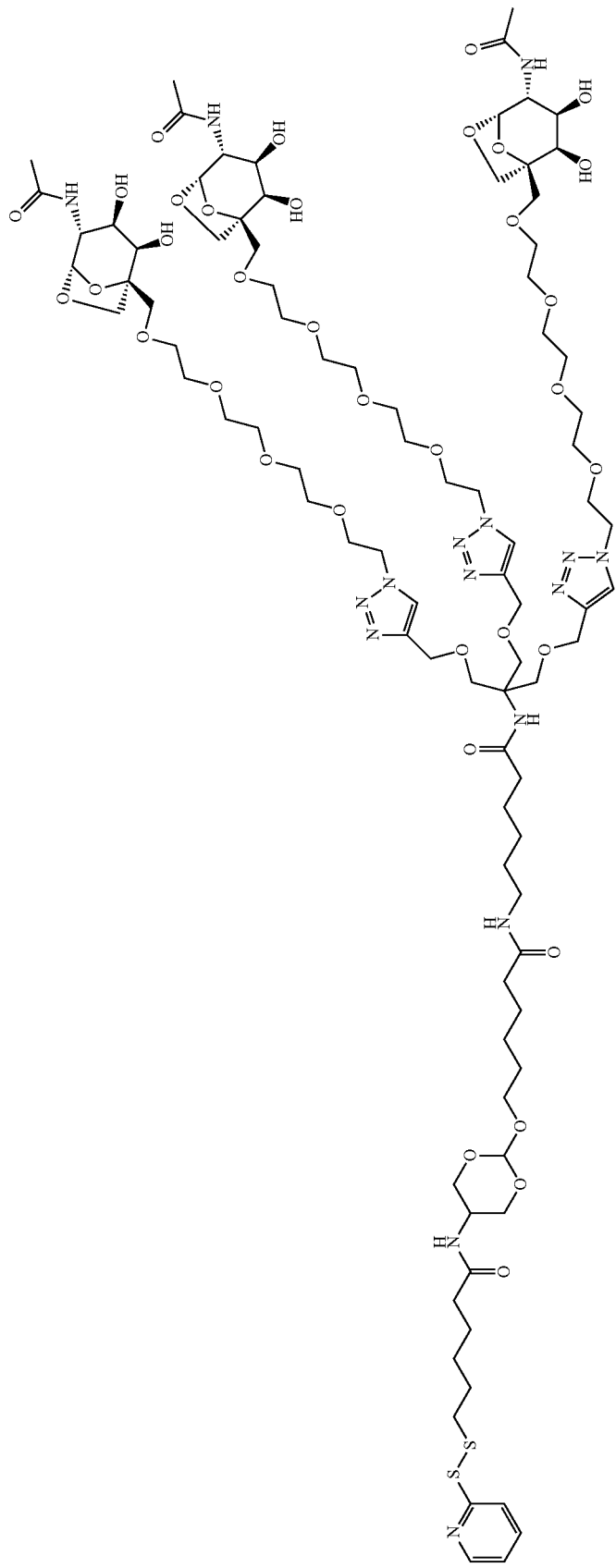

(66) or a pharmaceutically acceptable salt thereof.

* * * * *